US012709748B2

(12) United States Patent
Soundarapandian et al.

(10) Patent No.: US 12,709,748 B2
(45) **Date of Patent: *Aug. 18, 2026**

(54) HUNTINGTIN (HTT) iRNA AGENT COMPOSITIONS AND METHODS OF USE THEREOF

(71) Applicant: Alnylam Pharmaceuticals, Inc., Cambridge, MA (US)

(72) Inventors: Mangala Meenakshi Soundarapandian, Cambridge, MA (US); James D. McIninch, Burlington, MA (US); Bret Lee Bostwick, Cambridge, MA (US); Mark K. Schlegel, Boston, MA (US); Adam Castoreno, Framingham, MA (US); Jeffrey Zuber, Somerville, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 1035 days.

This patent is subject to a terminal disclaimer.

(21) Appl. No.: 17/731,317

(22) Filed: Apr. 28, 2022

(65) Prior Publication Data

US 2022/0380762 A1 Dec. 1, 2022

Related U.S. Application Data

(63) Continuation of application No. PCT/US2020/057849, filed on Oct. 29, 2020.

(Continued)

(51) Int. Cl.
*C12N 15/113* (2010.01)
*C12N 5/071* (2010.01)

(52) U.S. Cl.
CPC ............ *C12N 15/113* (2013.01); *C12N 5/067* (2013.01); *C12N 2310/14* (2013.01);

(Continued)

(58) Field of Classification Search
CPC .............. C12N 15/113; C12N 2310/14; C12N 2310/315; C12N 2310/3515; A61K 31/713; A61K 48/00
See application file for complete search history.

(56) References Cited

U.S. PATENT DOCUMENTS 7,902,352 B2 3/2011 Kaemmerer et al.
7,947,658 B2 5/2011 Aronin et al.

(Continued)

FOREIGN PATENT DOCUMENTS

WO WO-2004094595 A2 11/2004
WO WO-2005105995 A2 11/2005

(Continued)

OTHER PUBLICATIONS

DiFiglia et al. "Therapeutic silencing of mutant huntingtin with siRNA attenuates striatal and cortical neuropathology and behavioral deficits", PNAS, 104(43), 2007, pp. 17205-1709.

(Continued)

*Primary Examiner* — Terra C Gibbs
(74) *Attorney, Agent, or Firm* — McCarter & English, LLP; Maria Laccotripe Zacharakis; Deborah L. Nagle

(57) ABSTRACT

The disclosure relates to double stranded ribonucleic acid (dsRNAi) agents and compositions targeting a Huntingtin (HTT) gene, e.g., exon 1 of an HTT gene, as well as methods of inhibiting expression of an HTT gene and methods of treating subjects having an HTT-associated disease or disorder, e.g., Huntington's disease, using such dsRNAi agents and compositions.

29 Claims, 13 Drawing Sheets

Specification includes a Sequence Listing.

Related U.S. Application Data

(60) Provisional application No. 62/929,174, filed on Nov. 1, 2019.

(52) U.S. Cl.
CPC .................. *C12N 2310/315* (2013.01); *C12N 2310/3515* (2013.01); *C12N 2320/30* (2013.01)

(56) References Cited

U.S. PATENT DOCUMENTS

| | | | |
|---|---|---|---|
| 7,951,934 | B2 | 5/2011 | Freier |
| 8,183,219 | B2 | 5/2012 | Burright |
| 8,258,112 | B2 | 9/2012 | Kaemmerer et al. |
| 8,415,465 | B2 | 4/2013 | Freier |
| 8,557,975 | B2 | 10/2013 | Kaemmerer et al. |
| 8,680,063 | B2 | 3/2014 | Aronin et al. |
| 8,779,116 | B2 | 7/2014 | Davidson et al. |
| 8,841,260 | B2 | 9/2014 | Miller et al. |
| 8,906,873 | B2 | 12/2014 | Hung et al. |
| 8,952,145 | B2 | 2/2015 | Freier |
| 8,987,222 | B2 | 3/2015 | Aronin et al. |
| 9,057,066 | B2 | 6/2015 | Hung et al. |
| 9,340,785 | B2 | 5/2016 | Corey et al. |
| 9,353,372 | B2 | 5/2016 | Freier |
| 9,434,943 | B2 | 9/2016 | Aronin et al. |
| 9,809,817 | B2 | 11/2017 | Khvorova et al. |
| 9,914,924 | B2 | 3/2018 | Aronin et al. |
| 9,920,321 | B2 | 3/2018 | Freier |
| 10,174,321 | B2 | 1/2019 | Konstantinova et al. |
| 10,344,277 | B2 | 7/2019 | Aronin et al. |
| 10,369,201 | B2 | 8/2019 | Zhang |
| 10,435,688 | B2 | 10/2019 | Khvorova et al. |
| 10,533,172 | B2 | 1/2020 | Southwell et al. |
| 10,655,129 | B2 | 5/2020 | Freier |
| 10,738,307 | B2 | 8/2020 | Hung et al. |
| 10,767,180 | B2 | 9/2020 | Konstantinova et al. |
| 10,774,327 | B2 | 9/2020 | Khvorova et al. |
| 11,072,794 | B2 | 7/2021 | Freier |
| 11,230,713 | B2 | 1/2022 | Khvorova et al. |
| 11,299,734 | B2 | 4/2022 | Aronin et al. |
| 11,371,044 | B2 | 6/2022 | Konstantinova et al. |
| 11,674,952 | B2 | 6/2023 | Brivanlou et al. |
| 11,993,774 | B2 * | 5/2024 | Soundarapandian ........................ C12N 15/113 |
| 2009/0036395 | A1 | 2/2009 | Davidson et al. |
| 2009/0176728 | A1 | 7/2009 | Yague et al. |
| 2020/0123543 | A1 | 4/2020 | Khvorova et al. |
| 2020/0339992 | A1 | 10/2020 | Konstantinova et al. |
| 2020/0385740 | A1 | 12/2020 | Khvorova et al. |
| 2021/0017522 | A1 | 1/2021 | Hung et al. |
| 2021/0071177 | A1 | 3/2021 | Khvorova et al. |
| 2022/0010309 | A1 | 1/2022 | Khvorova et al. |
| 2022/0042013 | A1 | 2/2022 | Freier |
| 2022/0090069 | A1 | 3/2022 | Khvorova et al. |
| 2022/0098585 | A1 | 3/2022 | Brown et al. |
| 2022/0251554 | A1 | 8/2022 | Khvorova et al. |
| 2023/0392152 | A1 | 12/2023 | Soundarapandian et al. |
| 2024/0368594 | A1 | 11/2024 | Soundarapandian et al. |
| 2025/0011776 | A1 | 1/2025 | Cantley et al. |

FOREIGN PATENT DOCUMENTS

| | | | |
|---|---|---|---|
| WO | WO-2007/022506 | A2 | 2/2007 |
| WO | WO-2007022470 | A2 | 2/2007 |
| WO | WO-2007051045 | A2 | 5/2007 |
| WO | WO-2007089584 | A2 | 8/2007 |
| WO | WO-2008021149 | A2 | 2/2008 |
| WO | WO-2008150897 | A2 | 12/2008 |
| WO | WO-2012177906 | A1 | 12/2012 |
| WO | WO-2013074974 | A2 | 5/2013 |
| WO | WO-2013162363 | A1 | 10/2013 |
| WO | WO 2015/054676 | A1 | 4/2015 |
| WO | WO-2016028649 | A1 | 2/2016 |
| WO | WO-2016102664 | A1 | 6/2016 |
| WO | WO-2016161374 | A1 | 10/2016 |
| WO | WO-2018057855 | A1 | 3/2018 |
| WO | WO-2018098328 | A1 | 5/2018 |
| WO | WO-2019217459 | A1 | 11/2019 |
| WO | WO-2019222479 | A1 | 11/2019 |
| WO | WO-2020097044 | A1 | 5/2020 |
| WO | WO-2020160336 | A1 | 8/2020 |
| WO | WO-2020198509 | A2 | 10/2020 |
| WO | WO-2021053018 | A1 | 3/2021 |
| WO | WO-2021087036 | A1 | 5/2021 |
| WO | WO-2021115141 | A1 | 6/2021 |
| WO | WO-2021216556 | A2 | 10/2021 |
| WO | WO-2022031591 | A2 | 2/2022 |
| WO | WO-2022061378 | A2 | 3/2022 |
| WO | WO-2022077024 | A1 | 4/2022 |
| WO | WO-2022/212231 | A2 | 10/2022 |
| WO | WO-2023/076450 | A2 | 5/2023 |

OTHER PUBLICATIONS

Peel et al., "Conjugation and Evaluation of Small Hydrophobic Molecules to Triazole-Linked SiRNAs", ACS Med. Chem. Lett. 2015, 6, 117?122.

Neueder et al., "The pathogenic exon 1 HTT protein is produced by incomplete splicing in Huntington's disease patients", Scientific Reports vol. 7, Article No. 1307 (2017).

Romo et al., A Fresh Look at Huntingtin mRNA Processing in Huntington's Disease, J. Huntington;s Dis. 2018 7 101-108.

Sathasivam et al, Aberrant splicing of HTT generates the pathogenic exon 1 protein in Huntington disease, PNAS 2013 110:2366-70.

Gipson et al., "Aberrantly spliced HTT, a new player in Huntington's disease pathogenesis", RNA Biology, vol. 10, No. 11, Nov. 1, 2013 (Nov. 1, 2013), pp. 1647-1652.

Miniarikova et al., "Design, Characterization, and Lead Selection of Therapeutic miRNAs Targeting Huntingtin for Development of Gene Therapy for Huntington's Disease", Molecular Therapy—Nucleic Acids vol. 5, No. 3, Mar. 22, 2016 (Mar. 22, 2016), p. e297.

Tabrizi et al., "Huntingtin Lowering Strategies for Disease Modification in Huntington's Disease", Neuron, vol. 101, No. 5, Mar. 6, 2019 (Mar. 6, 2019), pp. 801-819.

Aguiar et al., "RNAi mechanisms in Huntington's disease therapy: siRNA versus shRNA", Translational Neurodegeneration, Biomed Central Ltd, London, UK, vol. 6, No. 1, Nov. 27, 2017 (Nov. 27, 2017), pp. 1-10.

Yamada et al., Versatile Site-Specific Conjugation of Small Molecules to siRNA Using Click Chemistry, vol. 76, No. 5, Feb. 7, 2011 (Feb. 7, 2011), pp. 1198-1211.

Haraszti et al., "5'-Vinylphosphonate improves tissue accumulation and efficacy of conjugated siRNAs in vivo", Nucleic Acids Research, vol. 45, No. 13, Jun. 7, 2017 (Jun. 7, 2017), pp. 7581-7592.

International Preliminary report on Patentability from PCT/US2020/057849, mailed May 12, 2022.

Androsavich, "Frameworks for transformational breakthroughs in RNA-based medicines", Nature Reviews Drug Discovery, vol. 23, Jun. 2024, 421-444.

Foster et al., "Advanced siRNA Designs Further Improve In Vivo Performance of GalNAc-siRNA Conjugates", Mol Ther. Mar. 7, 2018;26(3):708-717.

Ui-Tei et al., "Functional dissection of siRNA sequence by systematic DNA substitution: modified siRNA with a DNA seed arm is a powerful tool for mammalian gene silencing with significantly reduced off-target effect", Nucleic Acids Res. Apr. 2008;36(7):2136-51.

Chernikov et al., "Current Development of siRNA Bioconjugates: From Research to the Clinic", Front Pharmacol. Apr. 2, 20196:10:444.

Hu et al., "Therapeutic siRNA: state of the art", Signal Transduction and Targeted Therapy (2020) 5:101.

Nair et al., "Impact of enhanced metabolic stability on pharmacokinetics and pharmacodynamics of GalNAc-siRNA conjugates". Nucleic Acids Res. Nov. 2, 2017;45(19):10969-10977.

Nair et al. "Multivalent N-Acetylgalactosamine-Conjugated siRNA Localizes in Hepatocytes and Elicits Robust RNAi-Mediated Gene Silencing"J. Am. Chem. Soc. 2014, 136, 16958-16961.

(56) References Cited

OTHER PUBLICATIONS

Shukla et al., "Exploring chemical modifications for siRNA therapeutics: a structural and functional outlook", ChemMedChem. Mar. 1, 2010;5(3):328-49.
Vickers et al., Efficient reduction of target RNAs by small interfering RNA and RNase H-dependent antisense agents. A comparative analysis. J Biol Chem. Feb. 28, 2003;278(9):7108-18.
Reynolds et al., Rational siRNA design for RNA interference. Nat Biotechnol. Mar. 2004;22(3):326-30.

* cited by examiner

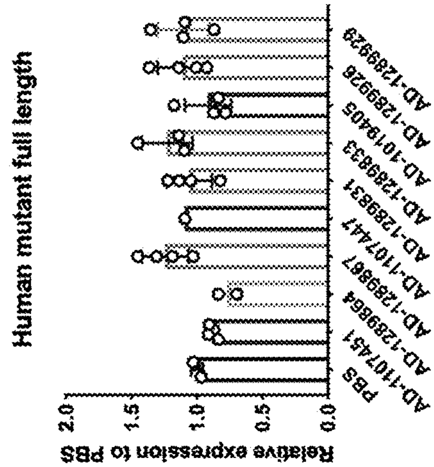
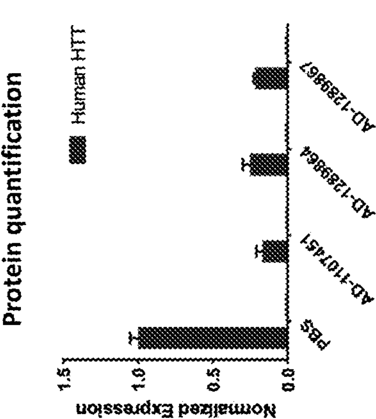
FIG.6

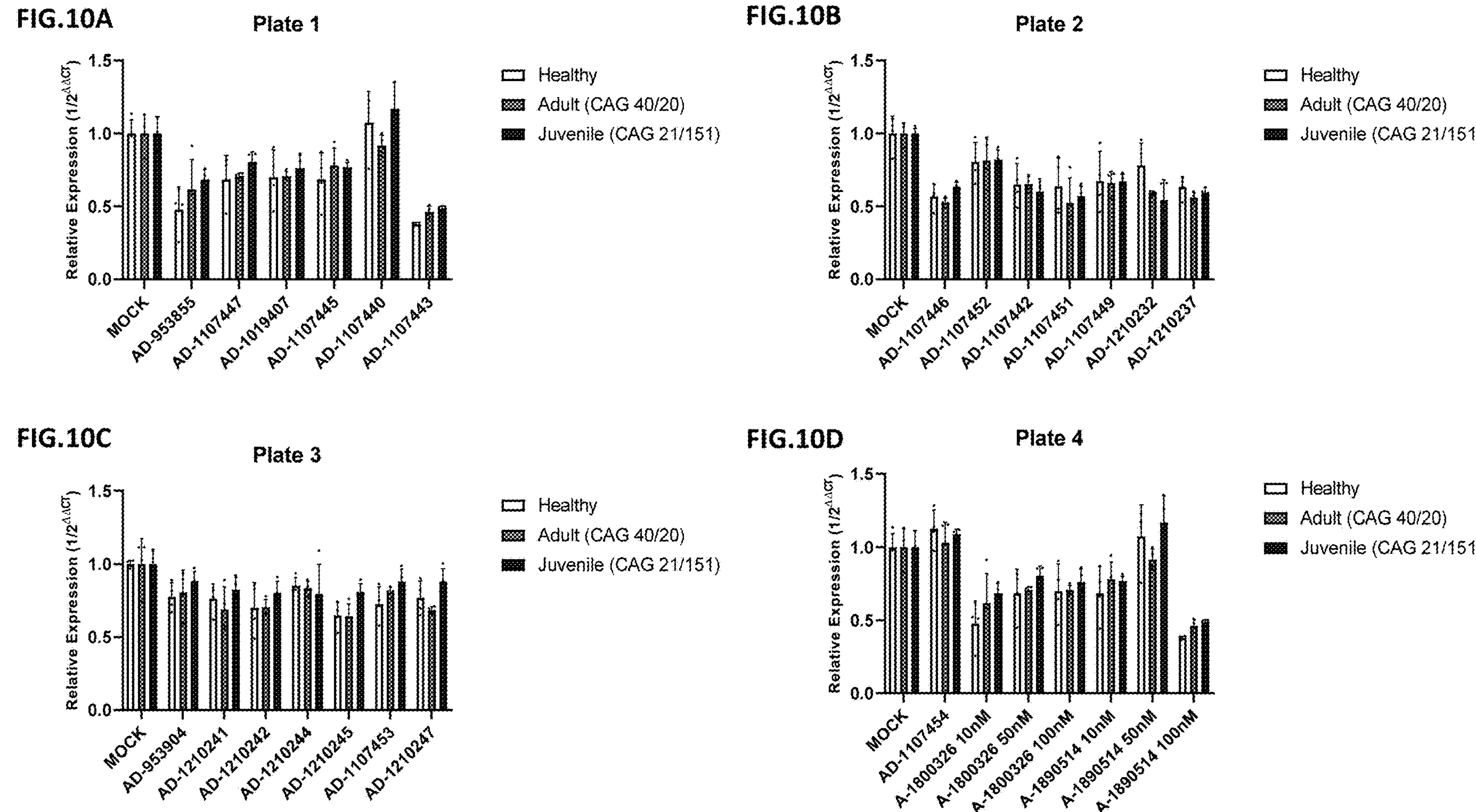
FIG.10A
Plate 1
Relative Expression (1/2^ΔΔCT)
1.5
1.0
0.5
0.0
MOCK
AD-953855
AD-1107447
AD-1019407
AD-1107445
AD-1107440
AD-1107443
Healthy
Adult (CAG 40/20)
Juvenile (CAG 21/151)
FIG.10B
Plate 2
Relative Expression (1/2^ΔΔCT)
1.5
1.0
0.5
0.0
MOCK
AD-1107446
AD-1107452
AD-1107442
AD-1107451
AD-1107449
AD-1210232
AD-1210237
Healthy
Adult (CAG 40/20)
Juvenile (CAG 21/151)
FIG.10C
Plate 3
Relative Expression (1/2^ΔΔCT)
1.5
1.0
0.5
0.0
MOCK
AD-953904
AD-1210241
AD-1210242
AD-1210244
AD-1210245
AD-1107453
AD-1210247
Healthy
Adult (CAG 40/20)
Juvenile (CAG 21/151)
FIG.10D
Plate 4
Relative Expression (1/2^ΔΔCT)
1.5
1.0
0.5
0.0
MOCK
AD-1107454
A-1800326 10nM
A-1800326 50nM
A-1800326 100nM
A-1890514 10nM
A-1890514 50nM
A-1890514 100nM
Healthy
Adult (CAG 40/20)
Juvenile (CAG 21/151)

Relative Expression (1/2^ΔΔCT)
1.5
1.0
0.5
0.0
MOCK
AD-1107450.5
AD-1289840.1
AD-1289848.1
AD-1019402.3
AD-1289914.1
AD-1019426.3
AD-1289948.1

Healthy
Adult HD (42/20)
Juvenile HD (21/151)
Relative Expression (1/2^ΔΔCT)
1.5
1.0
0.5
0.0
MOCK
AD-1289950.1
AD-1107449.5
AD-1289957.1
AD-1289960.1
AD-1107444.3
AD-1289816.1
AD-1289819.1

Relative Expression (1/2^ΔΔCT)
1.5
1.0
0.5
0.0
MOCK
AD-1019376
AD-1289886.1
AD-1019419.3
AD-1289906.1
AD-1289907.1
AD-1289909.1
AD-1019372.3

Relative Expression (1/2^ΔΔCT)
1.5
1.0
0.5
0.0
MOCK
AD-1289964.1
AD-1107442.5
AD-1289853.1
AD-1289860.1
A-1800326 10nM
A-1800326 50nM
A-1800326 100nM

HUNTINGTIN (HTT) iRNA AGENT COMPOSITIONS AND METHODS OF USE THEREOF

RELATED APPLICATIONS

This application is a 35 § U.S.C. 111(a) continuation application which claims the benefit of priority to PCT/US2020/057849, filed on Oct. 29, 2020, which, in turn, claims the benefit of priority to U.S. Provisional Application No. 62/929,174, filed on Nov. 1, 2019. The entire contents of each of the foregoing applications are incorporated herein by reference.

SEQUENCE LISTING

The instant application contains a Sequence Listing which has been submitted electronically in ASCII format and is hereby incorporated by reference in its entirety. Said ASCII copy, created on Apr. 27, 2022, is named 121301_10302_SL.txt and is 1,468,973 bytes in size.

BACKGROUND OF THE INVENTION

Huntington's disease is a progressive neurodegenerative disorder characterized by motor disturbance, cognitive loss and psychiatric manifestations (Martin and Gusella (1986) *N. Engl. J. Med.* 315:1267-1276). It is inherited in an autosomal dominant fashion, and affects about 1/10,000 individuals in most populations of European origin (Harper, P. S. et al., in *Huntington's Disease*, W. B. Saunders, Philadelphia, 1991). The hallmark of Huntington's disease is a distinctive choreic movement disorder that typically has a subtle, insidious onset in the fourth to fifth decade of life and gradually worsens over a course of 10 to 20 years until death. Occasionally, Huntington's disease is expressed in juveniles typically manifesting with more severe symptoms including rigidity and a more rapid course. Juvenile onset of Huntington's disease is associated with a preponderance of paternal transmission of the disease allele. The neuropathology of Huntington's disease also displays a distinctive pattern, with selective loss of neurons that is most severe in the caudate and putamen regions of the brain.

Huntington's disease has been shown to be caused by an expanding glutamine repeat in exon 1 of a gene termed IT15 or Huntingtin (HTT). Although this gene is widely expressed and is required for normal development, the pathology of Huntington's disease is restricted to the brain, for reasons that remain poorly understood. In patients having HD (an autosomal dominant disease), the expansion of the polyglutamine repeat results in a wild-type transcript, a full-length mutant transcript having the expanded polyglutamine repeat, as well as a truncated mutant transcript having the expanded polyglutamine repeat. It has been shown that, although the Huntingtin gene product is expressed at similar levels in patients and controls, it is the expansion of the polyglutamine repeat and the presence of the full-length mutant transcript and the truncated mutant transcript that induces toxicity Effective treatment for Huntington's disease is currently not available. The choreic movements and agitated behaviors may be suppressed, usually only partially, by antipsychotics (e.g., chlorpromazine) or reserpine until adverse effects of lethargy, hypotension, or parkinsonism occur. In addition, despite significant advances in the field of RNAi and Huntington's disease treatment, there remains a need for an agent that can selectively and efficiently silence the HD gene using the cell's own RNAi machinery that has both high biological activity and in vivo stability, and that can effectively inhibit expression of a target Huntingtin gene.

BRIEF SUMMARY OF THE INVENTION

The present disclosure provides RNAi agent compositions which effect the RNA-induced silencing complex (RISC)-mediated cleavage of RNA transcripts of a huntingtin (HTT) gene. The HTT gene may be within a cell, e.g., a cell within a subject, such as a human. The present disclosure also provides methods of using the RNAi agent compositions of the disclosure for inhibiting the expression of an HTT gene or for treating a subject who would benefit from inhibiting or reducing the expression of an HTT gene, e.g., a subject suffering or prone to suffering from an HTT-associated disease.

In one aspect, the present invention provides a double stranded ribonucleic acid (dsRNA) agent for inhibiting expression of Huntingtin (HTT), wherein the dsRNA agent comprises a sense strand and an antisense strand forming a double stranded region, wherein the sense strand comprises at least 15, 16, 17, 18, 19, 20, or 21 contiguous nucleotides differing by no more than 3, 2, 1, or 0 nucleotides from the nucleotide sequence of SEQ ID NO: 1 and the antisense strand comprises at least 15, 16, 17, 18, 19, 20, or 21 contiguous nucleotides differing by no more than 3, 2, 1, or 0 nucleotides from the nucleotide sequence of SEQ ID NO: 6, and wherein one or more lipophilic moieties are conjugated to one or more internal positions on at least one strand.

In some embodiments, the nucleotide sequence of the sense strand comprises any one of the sense strand nucleotide sequences in any one of Tables 2, 3, 5, 6, 8, 9, 11, 12, 14, 15, 17, 18, 20, 21, 24, 25, 27-30, 32 and 33.

In some embodiments, the sense strand comprises at least 15 contiguous nucleotides differing by no more than 0, 1, 2, or 3 nucleotides from any one of the nucleotide sequence of nucleotides 618-640, 1215-1237, 1248-1270, 1403-1425, 4051-4073, 4393-4415, 4398-4420, 4403-4425, 4441-4463, 4518-4540, 4548-4570, 5105-5127, 5215-5237, 5217-5239, 5221-5243, 5222-5244, 5366-5388, 5372-5394, 5450-5472, 5509-5531, 5883-5905, 6009-6031, 6010-6032, 6011-6033, 6012-6034, 6013-6035, 6014-6036, 6015-6037, 6347-6369, 6512-6534, 7523-7545, 7525-7547, 7526-7548, 9127-9149, 9531-9553, or 9538-9560 of SEQ ID NO:1.

In some embodiments, the antisense strand comprises at least 15 contiguous nucleotides differing by nor more than 0, 1, 2, or 3 nucleotides from any one of the antisense strand nucleotide sequences of a duplex selected from the group consisting of AD-953769.1, AD-953778.1, AD-953784.1, AD-953786.1, AD-953849.1, AD-953854.1, AD-953855.1, AD-953857.1, AD-953862.1, AD-953866.1, AD-953867.1, AD-953880.1, AD-953883.1, AD-953884.1, AD-953885.1, AD-953886.1, AD-953887.1, AD-953888.1, AD-953889.1, AD-953891.1, AD-953896.1, AD-953898.1, AD-953899.1, AD-953900.1, AD-953901.1, AD-953902.1, AD-953903.1, AD-953904.1, AD-953907.1, AD-953911.1, AD-953921.1, AD-953923.1, AD-953924.1, AD-953932.1, and AD-953933.1, AD-953937.1.

In some embodiments, the lipophilic moiety is conjugated via a linker or a carrier.

In another aspect, the present invention provides a double stranded ribonucleic acid (dsRNA) for inhibiting expression of Huntingtin (HTT) in a cell, wherein the dsRNA comprises a sense strand and an antisense strand forming a double stranded region, wherein the antisense strand comprises a region of complementarity to an mRNA encoding HTT, and wherein the region of complementarity comprises at least 15, e.g., 15, 16, 17, 18, 19, 20, or 21, contiguous nucleotides differing by no more than 3, 2, 1, or 0 nucleotides from any one of the antisense nucleotide sequences in any one of Tables 2, 3, 5, 6, 8, 9, 11, 12, 14, 15, 17, 18, 20, 21, 24, 25, 27-30, 32 and 33.

The sense strand, the antisense strand, or both the sense strand and the antisense strand may be conjugated to one or more lipophilic moieties. In some embodiments, the lipophilic moiety is conjugated to one or more internal positions in the double stranded region of the dsRNA agent, e.g., the one or more lipophilic moieties may be conjugated to one or more internal positions on the antisense strand. In some embodiments, the one or more lipophilic moieties are conjugated to one or more internal positions on at least one strand via a linker or carrier.

In some embodiments, lipophilicity of the lipophilic moiety, measured by log Kow, exceeds 0.

In some embodiments, the hydrophobicity of the dsRNA agent, measured by the unbound fraction in a plasma protein binding assay of the dsRNA agent, exceeds 0.2. In some embodiments, the plasma protein binding assay is an electrophoretic mobility shift assay using human serum albumin protein.

In some embodiments, the internal positions include all positions except the terminal two positions from each end of the sense strand or the antisense strand. In other embodiments, the internal positions include all positions except the terminal three positions from each end of the sense strand or the antisense strand.

In some embodiments, the internal positions exclude a cleavage site region of the sense strand, such as the internal positions include all positions except positions 9-12, counting from the 5'-end of the sense strand or the internal positions include all positions except positions 11-13, counting from the 3'-end of the sense strand.

In some embodiments, the internal positions exclude a cleavage site region of the antisense strand. In other embodiments, the internal positions include all positions except positions 12-14, counting from the 5'-end of the antisense strand. In some embodiments, the internal positions include all positions except positions 11-13 on the sense strand, counting from the 3'-end, and positions 12-14 on the antisense strand, counting from the 5'-end.

In some embodiments, the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand.

In some embodiments, the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

In some embodiments, the positions in the double stranded region exclude a cleavage site region of the sense strand.

In some embodiments, the sense strand is 21 nucleotides in length, the antisense strand is 23 nucleotides in length, and the lipophilic moiety is conjugated to position 20, position 15, position 1, position 7, position 6, or position 2 of the sense strand or position 16 of the antisense strand.

In other embodiments, the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand.

In some embodiments, the lipophilic moiety is an aliphatic, alicyclic, or polyalicyclic compound.

In some embodiments, the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine.

In some embodiments, the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

In some embodiments, the lipophilic moiety contains a saturated or unsaturated C6-C18 hydrocarbon chain.

In some embodiments, the lipophilic moiety contains a saturated or unsaturated C16 hydrocarbon chain. In some embodiments, the saturated or unsaturated C16 hydrocarbon chain is conjugated to position 6, counting from the 5'-end of the strand.

In some embodiments, the lipophilic moiety is conjugated via a carrier that replaces one or more nucleotide(s) in the internal position(s) or the double stranded region. In some embodiments, the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

In some embodiments, the lipophilic moiety is conjugated to the dsRNA agent via a linker containing an ether, thioether, urea, carbonate, amine, amide, maleimide-thioether, disulfide, phosphodiester, sulfonamide linkage, a product of a click reaction, or carbamate.

In some embodiments, the lipophilic moiety is conjugated to a nucleobase, sugar moiety, or internucleosidic linkage.

In some embodiments, the dsRNA agent comprises at least one modified nucleotide. In some embodiments, no more than five of the sense strand nucleotides and no more than five of the nucleotides of the antisense strand are unmodified nucleotides. In other embodiments, all of the nucleotides of the sense strand and all of the nucleotides of the antisense strand comprise a modification.

In some embodiments, at least one of the modified nucleotides is selected from the group a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphonate, a nucleotide comprising adenosine-glycol nucleic acid (GNA), a nucleotide comprising thymidine-glycol nucleic acid (GNA) S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, and a terminal nucleotide linked to a cholesteryl derivative and a dodecanoic acid bisdecylamide group; and combinations thereof.

In other embodiments, the modified nucleotide is selected from the group consisting of a 2'-deoxy-2'-fluoro modified nucleotide, a 2'-deoxy-modified nucleotide, 3'-terminal deoxy-thymine nucleotides (dT), a locked nucleotide, an abasic nucleotide, a 2'-amino-modified nucleotide, a 2'-alkyl-modified nucleotide, a morpholino nucleotide, a phosphoramidate, and a non-natural base comprising nucleotide.

In some embodiments, at least one of the modified nucleotides is selected from the group consisting of a deoxy-nucleotide, a 2'-O-methyl modified nucleotide, a 2'-fluoro modified nucleotide, a 2'-deoxy-modified nucleotide, a glycol modified nucleotide (GNA), and, a vinyl-phosphonate nucleotide; and combinations thereof.

In some embodiments, at least one of the modifications on the nucleotides is a thermally destabilizing nucleotide modification. In some embodiments, the thermally destabilizing nucleotide modification is selected from the group consisting of an abasic modification; a mismatch with the opposing nucleotide in the duplex; and destabilizing sugar modification, a 2'-deoxy modification, an acyclic nucleotide, an unlocked nucleic acids (UNA), and a glycerol nucleic acid (GNA)

In some embodiments, the modified nucleotide comprises a short sequence of 3'-terminal deoxy-thymine nucleotides (dT).

In some embodiments, the modifications on the nucleotides are 2'-O-methyl, GNA and 2'fluoro modifications.

In some embodiments, the dsRNA agent further comprises at least one phosphorothioate internucleotide linkage. In some embodiments, the dsRNA agent comprises 6-8 phosphorothioate internucleotide linkages. In one embodiment, the phosphorothioate or methylphosphonate internucleotide linkage is at the 3'-terminus of one strand. Optionally, the strand is the antisense strand. In another embodiment, the strand is the sense strand. In a related embodiment, the phosphorothioate or methylphosphonate internucleotide linkage is at the 5'-terminus of one strand. Optionally, the strand is the antisense strand. In another embodiment, the strand is the sense strand. In another embodiment, the phosphorothioate or methylphosphonate internucleotide linkage is at the both the 5'- and 3'-terminus of one strand. Optionally, the strand is the antisense strand. In another embodiment, the strand is the sense strand.

In some embodiments, each strand is no more than 30 nucleotides in length.

In some embodiments, at least one strand comprises a 3' overhang of at least 1 nucleotide or a 3' overhang of at least 2 nucleotides.

The double stranded region may be 15-30 nucleotide pairs in length; 17-23 nucleotide pairs in length; 17-25 nucleotide pairs in length; 23-27 nucleotide pairs in length; 19-21 nucleotide pairs in length; or 21-23 nucleotide pairs in length.

Each strand may be 19-30 nucleotides; 19-23 nucleotides; or 21-23 nucleotides.

In some embodiments, the dsRNA agent further comprises a targeting ligand that targets a liver tissue. In some embodiments, the targeting ligand is a GalNAc conjugate.

In certain embodiments, the double-stranded RNAi agent further includes a targeting ligand that targets a receptor which mediates delivery to a CNS tissue, e.g., a hydrophilic ligand.

In certain embodiments, the targeting ligand is a C16 ligand. In one embodiment, the ligand is

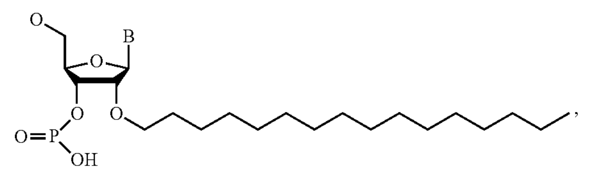

where B is a nucleotide base or a nucleotide base analog, optionally where B is adenine, guanine, cytosine, thymine or uracil.

In some embodiments, the lipophilic moeity or targeting ligand is conjugated via a biocleavable linker selected from the group consisting of DNA, RNA, disulfide, amide, functionalized monosaccharides or oligosaccharides of galactosamine, glucosamine, glucose, galactose, mannose, and combinations thereof.

In some embodiments, the 3' end of the sense strand is protected via an end cap which is a cyclic group having an amine, said cyclic group being selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.

In some embodiments, the dsRNA agent further comprises a terminal, chiral modification occurring at the first internucleotide linkage at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp configuration or Sp configuration.

In some embodiments, the dsRNA agent further comprises a terminal, chiral modification occurring at the first and second internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, second and third internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, and second internucleotide linkages at the 3' end of the antisense strand, having the linkage phosphorus atom in Sp configuration, a terminal, chiral modification occurring at the third internucleotide linkages at the 3' end of the antisense strand, having the linkage phosphorus atom in Rp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a terminal, chiral modification occurring at the first, and second internucleotide linkages at the 3' end of the antisense strand, having the linkage phosphorus atom in Sp configuration, a terminal, chiral modification occurring at the first, and second internucleotide linkages at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In some embodiments, the dsRNA agent further comprises a phosphate or phosphate mimic at the 5'-end of the antisense strand. In some embodiments, the phosphate mimic is a 5'-vinyl phosphonate (VP).

In some embodiments, the base pair at the 1 position of the 5'-end of the antisense strand of the duplex is an AU base pair.

In some embodiments, the sense strand has a total of 21 nucleotides and the antisense strand has a total of 23 nucleotides.

An additional aspect of the instant disclosure provides a double stranded RNAi agent for inhibiting expression of a huntingtin (HTT) gene, where the double stranded RNAi agent targeted to HTT includes a sense strand and an antisense strand forming a double stranded region, where the sense strand includes at least 15, e.g., 15, 16, 17, 18, 19, or 20, contiguous nucleotides differing by no more than 3 nucleotides (i.e., differing by 3, 2, 1, or 0 nucleotides) from any one of the nucleotide sequences of SEQ ID NOs: 1-5 and the antisense strand includes at least 15, e.g., 15, 16, 17, 18, 19, or 20, contiguous nucleotides differing by no more than 3 nucleotides (i.e., differing by 3, 2, 1, or 0 nucleotides) from any one of the nucleotide sequences of SEQ ID NOs: 6-10; where a substitution of a uracil for any thymine in the sequences provided in the SEQ ID NOs: 1-10 (when comparing aligned sequences) does not count as a difference that contributes to the differing by no more than 3 nucleotides from any one of the nucleotide sequences provided in SEQ ID NOs: 1-10, where substantially all of the nucleotides of the sense strand include a modification that is a 2'-O-methyl modification, a GNA or a 2'-fluoro modification, where the sense strand includes two phosphorothioate internucleotide linkages at the 5'-terminus, where substantially all of the nucleotides of the antisense strand include a modification selected from the group consisting of a 2'-O-methyl modification and a 2'-fluoro modification, where the antisense strand includes two phosphorothioate internucleotide linkages at the 5'-terminus and two phosphorothioate internucleotide linkages at the 3'-terminus, and where the sense strand is conjugated to one or more lipophilic, e.g., C16, ligands.

Another aspect of the instant disclosure provides a double stranded RNAi agent for inhibiting expression of a huntingtin (HTT) gene, where the double stranded RNAi agent targeted to HTT includes a sense strand and an antisense strand forming a double stranded region, where the sense strand includes at least 15, e.g., 15, 16, 17, 18, 19, or 20, contiguous nucleotides differing by no more than 3 nucleotides (i.e., differing by 3, 2, 1, or 0 nucleotides) from any one of the nucleotide sequences of SEQ ID NOs: 1-5 and the antisense strand includes at least 15 contiguous nucleotides differing by no more than 3 nucleotides (i.e., differing by 3, 2, 1, or 0 nucleotides) from any one of the nucleotide sequences of SEQ ID NOs: 6-10, where a substitution of a uracil for any thymine in the sequences provided in the SEQ ID NOs: 1-10 (when comparing aligned sequences) does not count as a difference that contributes to the differing by no more than 3 nucleotides from any one of the nucleotide sequences provided in SEQ ID NOs:1-10; where the sense strand includes at least one 3'-terminal deoxy-thymine nucleotide (dT), and where the antisense strand includes at least one 3'-terminal deoxy-thymine nucleotide (dT).

An additional aspect of the instant disclosure provides a double stranded ribonucleic acid (RNAi) agent for inhibiting expression of a huntingtin (HTT) gene, where the RNAi agent possesses a sense strand and an antisense strand, and where the antisense strand includes a region of complementarity which includes at least 15 contiguous nucleotides differing by no more than 3 nucleotides (i.e., differing by 3, 2, 1, or 0 nucleotides), e.g., at least 15 nucleotides (i.e., differing by 3, 2, 1, or 0 nucleotides), at least 19 nucleotides (i.e., differing by 3, 2, 1, or 0 nucleotides), from any one of the antisense strand nucleobase sequences of Tables 2, 3, 5, 6, 8, 9, 11, 12, 14, 15, 17, 18, 20, 21, 24, 25, 27-30, 32 and 33. In one embodiment, the RNAi agent includes one or more of the following modifications: a 2'-O-methyl modified nucleotide, a 2'-fluoro modified nucleotide, a 2'-C-alkyl-modified nucleotide, a nucleotide comprising a glycol nucleic acid (GNA), a phosphorothioate (PS) and a vinyl phosphonate (VP). Optionally, the RNAi agent includes at least one of each of the following modifications: a 2'-O-methyl modified nucleotide, a 2'-fluoro modified nucleotide, a 2'-C-alkyl-modified nucleotide, a nucleotide comprising a glycol nucleic acid (GNA), a phosphorothioate and a vinyl phosphonate (VP).

In another embodiment, the RNAi agent includes four or more PS modifications, optionally six to ten PS modifications, optionally eight PS modifications.

In an additional embodiment, each of the sense strand and the antisense strand of the RNAi agent possesses a 5'-terminus and a 3'-terminus, and the RNAi agent includes eight PS modifications positioned at each of the penultimate and ultimate internucleotide linkages from the respective 3'- and 5'-termini of each of the sense and antisense strands of the RNAi agent.

In another embodiment, each of the sense strand and the antisense strand of the RNAi agent includes a 5'-terminus and a 3'-terminus, and the RNAi agent includes only one nucleotide including a GNA. Optionally, the nucleotide including a GNA is positioned on the antisense strand at the seventh nucleobase residue from the 5'-terminus of the antisense strand.

In an additional embodiment, each of the sense strand and the antisense strand of the RNAi agent includes a 5'-terminus and a 3'-terminus, and the RNAi agent includes one to four 2'-C-alkyl-modified nucleotides. Optionally, the 2'-C-alkyl-modified nucleotide is a 2'-C16-modified nucleotide. Optionally, the RNAi agent includes a single 2'-C-alkyl, e.g., C16-modified nucleotide. Optionally, the single 2'-C-alkyl, e.g., C16-modified nucleotide is located on the sense strand at the sixth nucleobase position from the 5'-terminus of the sense strand.

In another embodiment, each of the sense strand and the antisense strand of the RNAi agent includes a 5'-terminus and a 3'-terminus, and the RNAi agent includes two or more 2'-fluoro modified nucleotides. Optionally, each of the sense strand and the antisense strand of the RNAi agent includes two or more 2'-fluoro modified nucleotides. Optionally, the 2'-fluoro modified nucleotides are located on the sense strand at nucleobase positions 7, 9, 10 and 11 from the 5'-terminus of the sense strand and on the antisense strand at nucleobase positions 2, 14 and 16 from the 5'-terminus of the antisense strand.

In an additional embodiment, each of the sense strand and the antisense strand of the RNAi agent includes a 5'-terminus and a 3'-terminus, and the RNAi agent includes one or more VP modifications. Optionally, the RNAi agent includes a single VP modification at the 5'-terminus of the antisense strand.

In another embodiment, each of the sense strand and the antisense strand of the RNAi agent includes a 5'-terminus and a 3'-terminus, and the RNAi agent includes two or more 2'-O-methyl modified nucleotides. Optionally, the RNAi agent includes 2'-O-methyl modified nucleotides at all nucleobase locations not modified by a 2'-fluoro, a 2'-C-alkyl or a glycol nucleic acid (GNA). Optionally, the two or more 2'-O-methyl modified nucleotides are located on the sense strand at positions 1, 2, 3, 4, 5, 8, 12, 13, 14, 15, 16, 17, 18, 19, 20 and 21 from the 5'-terminus of the sense strand and on the antisense strand at positions 1, 3, 4, 5, 6, 8, 9, 10, 11, 12, 13, 15, 17, 18, 19, 20, 21, 22 and 23 from the 5'-terminus of the antisense strand.

In one embodiment, all of the nucleotides of the sense strand and all of the nucleotides of the antisense strand are modified nucleotides.

In another embodiment, each strand has 19-30 nucleotides.

In certain embodiments, the antisense strand of the RNAi agent includes at least one thermally destabilizing modification of the duplex within the first 9 nucleotide positions of the 5' region or a precursor thereof. Optionally, the thermally destabilizing modification of the duplex is one or more of

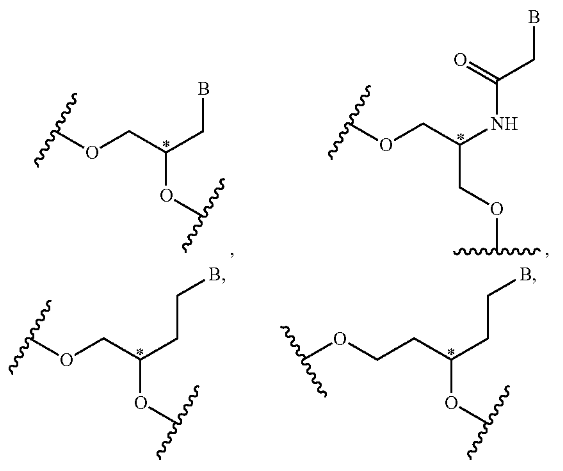

-continued

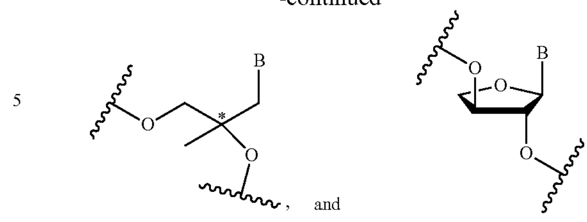

and where B is nucleobase.

The present invention further provides cells containing any of the dsRNA agents of the invention and pharmaceutical compositions for inhibiting expression of a gene encoding HTT, comprising any of the dsRNA agents of the invention.

In one embodiment, the double stranded RNAi agent is in an unbuffered solution. Optionally, the unbuffered solution is saline or water. In another embodiment, the double stranded RNAi agent is in a buffer solution. Optionally, the buffer solution includes acetate, citrate, prolamine, carbonate, or phosphate or any combination thereof. In another embodiment, the buffer solution is phosphate buffered saline (PBS). Another aspect of the disclosure provides a pharmaceutical composition that includes a double stranded RNAi agent of the instant disclosure and a lipid formulation. In one embodiment, the lipid formulation includes a lipid nanoparticle (LNP).

An additional aspect of the disclosure provides a method of inhibiting expression of an HTT gene in a cell, the method including (a) contacting the cell with a double stranded RNAi agent of the instant disclosure or a pharmaceutical composition of the instant disclosure; and (b) maintaining the cell produced in step (a) for a time sufficient to obtain degradation of the mRNA transcript of an HTT gene, thereby inhibiting expression of the HTT gene in the cell.

In one embodiment, the cell is within a subject. Optionally, the subject is a human.

In certain embodiments, the subject is a rhesus monkey, a cynomolgous monkey, a mouse, or a rat. In certain embodiments HTT expression is inhibited by at least about 50% by the RNAi agent.

In certain embodiments, the human subject has been diagnosed with an HTT-associated disease, e.g., Huntington's disease.

Another aspect of the disclosure provides a method of treating a subject diagnosed with an HTT-associated disease, e.g., Huntington's disease, the method including administering to the subject a therapeutically effective amount of a double stranded RNAi agent of the disclosure or a pharmaceutical composition of the disclosure, thereby treating the subject.

In one embodiment, treating comprises amelioration of at least on sign or symptom of the disease. In another embodiment, treating comprises prevention of progression of the disease.

In some embodiments, the dsRNA agent is administered to the subject at a dose of about 0.01 mg/kg to about 50 mg/kg.

In some embodiments, the dsRNA agent is administered to the subject intrathecally. In one embodiment, the method reduces the expression of an HTT gene in a brain (e.g., striatum) or spine tissue. Optionally, the brain or spine tissue is striatum, cortex, cerebellum, cervical spine, lumbar spine, or thoracic spine.

In some embodiments, the method further comprises measuring a level of HTT in a sample obtained from the subject.

Another aspect of the instant disclosure provides a method of inhibiting the expression of huntingtin (HTT) in a subject, the method involving: administering to the subject a therapeutically effective amount of a double stranded RNAi agent of the disclosure or a pharmaceutical composition of the disclosure, thereby inhibiting the expression of HTT in the subject.

In some embodiment, the method further comprises administering to the subject an additional agent suitable for treatment or prevention of an HTT-associated disorder.

BRIEF DESCRIPTIONS OF THE FIGURES

FIG. 1 is a graph showing wild-type human HTT mRNA levels in the livers of mice expressing a portion of wild-type human HTT (via AAV). These mice were subcutaneously administered a single 3 mg/kg dose of the indicated dsRNA duplexes targeting exon 1 of the human HTT transcript at Day 14 post AAV dose. Human HTT levels shown are normalized to AAV treated controls 14 days post siRNA dose.

FIG. 2 is a graph showing wild-type human HTT mRNA levels in the livers of mice expressing a portion of wild-type human HTT (via AAV). These mice were subcutaneously administered a single 3 mg/kg dose of the indicated dsRNA duplexes targeting exon 1 of the human HTT transcript at Day 14 post AAV dose. Human HTT levels shown are normalized to AAV treated controls 14 days post siRNA dose.

FIG. 6 is a graph showing full-length mutant human HTT mRNA levels in YAC128 mice subcutaneously administered a single 10 mg/kg dose of the indicated dsRNA duplexes at Day 7 post-dose and the corresponding full-length mutant human HTT protein levels in the livers. Mutant human mRNA and protein HTT levels shown are normalized to PBS treatment levels.

Figure 8B:
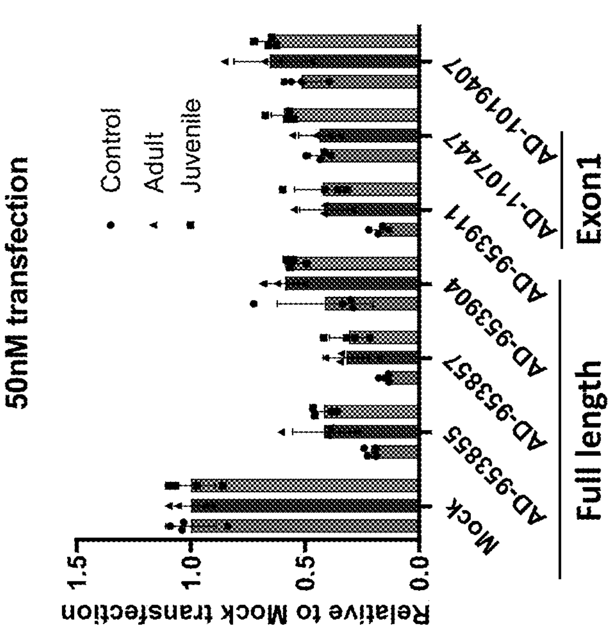
Figure 8A:
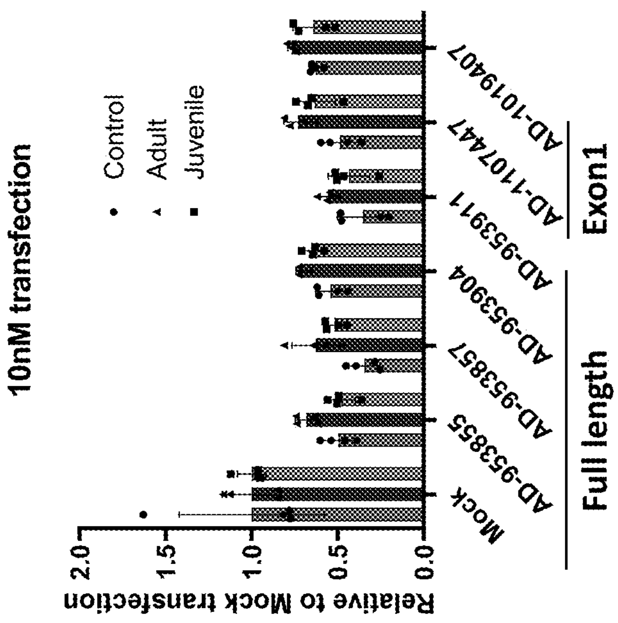

FIGS. 8A and 8B are graphs showing full-length human HTT mRNA levels in human fibroblasts transfected with 10 nM or 50 nM of the indicated dsRNA duplexes targeting various exons or exon 1 specifically of human HTT. Fibroblasts were obtained from Coriell, adult healthy control patient ("Control", GM02153), an HD patient with adult disease onset ("Adult", GM04478") and an HD patient with juvenile disease onset ("Juvenile", GM09197"). HTT levels shown are normalized to mock transfected controls.

Figure 9B:
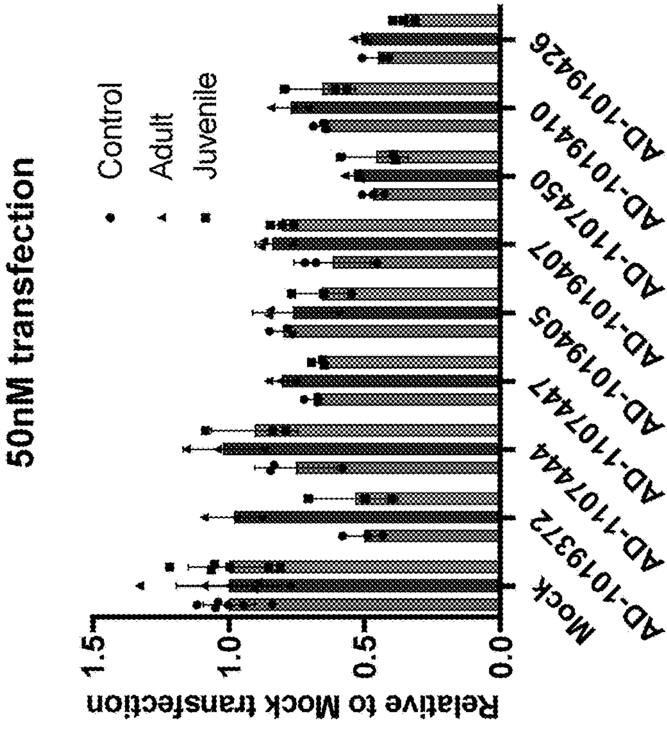
Figure 9A:
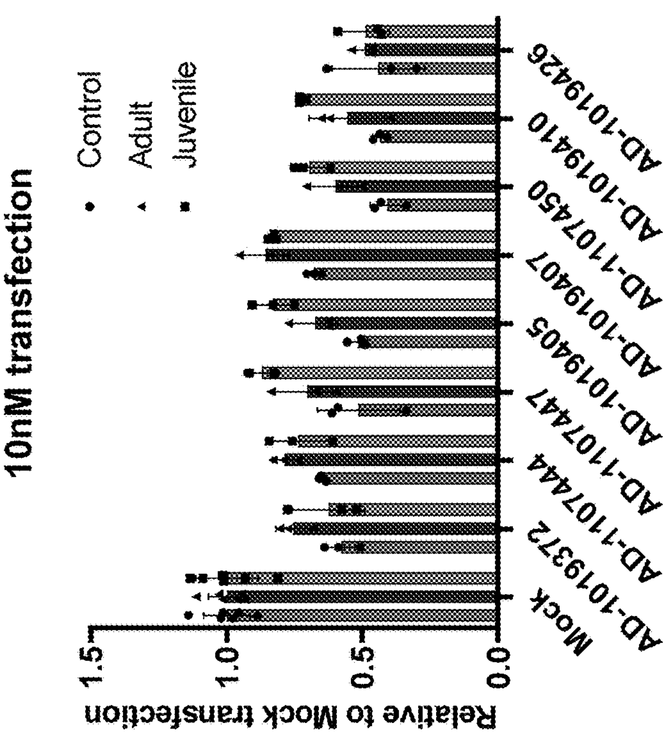
Figures 11A, 11B, 11C, 11D:
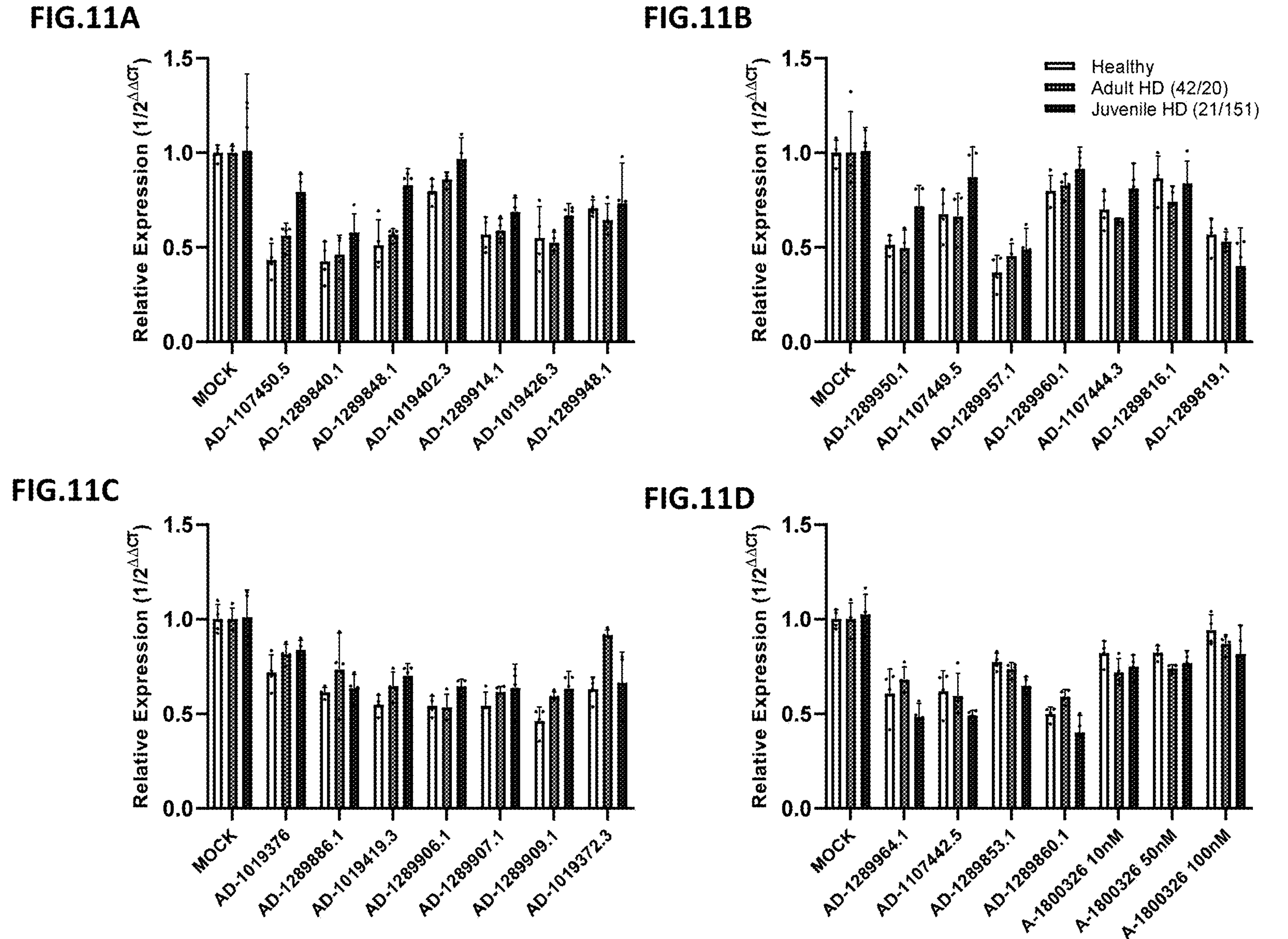

FIGS. 9A and 9B are graphs showing full-length human HTT mRNA levels in human fibroblasts transfected with 10 nM or 50 nM of the indicated dsRNA duplexes targeting various exons or exon 1 specifically of human HTT. Fibroblasts were obtained from Coriell, adult healthy control patient ("Control", GM02153), an HD patient with adult disease onset ("Adult", GM04478") and an HD patient with juvenile disease onset ("Juvenile", GM09197"). HTT levels shown are normalized to mock transfected controls.

FIGS. 10A-10D a are graphs showing full-length human HTT mRNA levels in human fibroblasts transfected with 10 nM or 50 nM of the indicated dsRNA duplexes targeting various exons or exon 1 specifically of human HTT. Fibroblasts were obtained from Coriell, adult healthy control patient ("Control", GM02153), an HD patient with adult disease onset ("Adult", GM04478") and an HD patient with juvenile disease onset ("Juvenile", GM09197"). HTT levels shown are normalized to mock transfected controls.

FIGS. 11A-11D are graphs showing full-length HTT mRNA mRNA levels in human fibroblasts transfected with 10 nM or 50 nM of the indicated dsRNA duplexes targeting various exons or exon 1 specifically of human HTT. Fibroblasts were obtained from Coriell, adult healthy control patient ("Control", GM02153), an HD patient with adult disease onset ("Adult", GM04478") and an HD patient with juvenile disease onset ("Juvenile", GM09197"). HTT levels shown are normalized to mock transfected controls.

Figure 12:
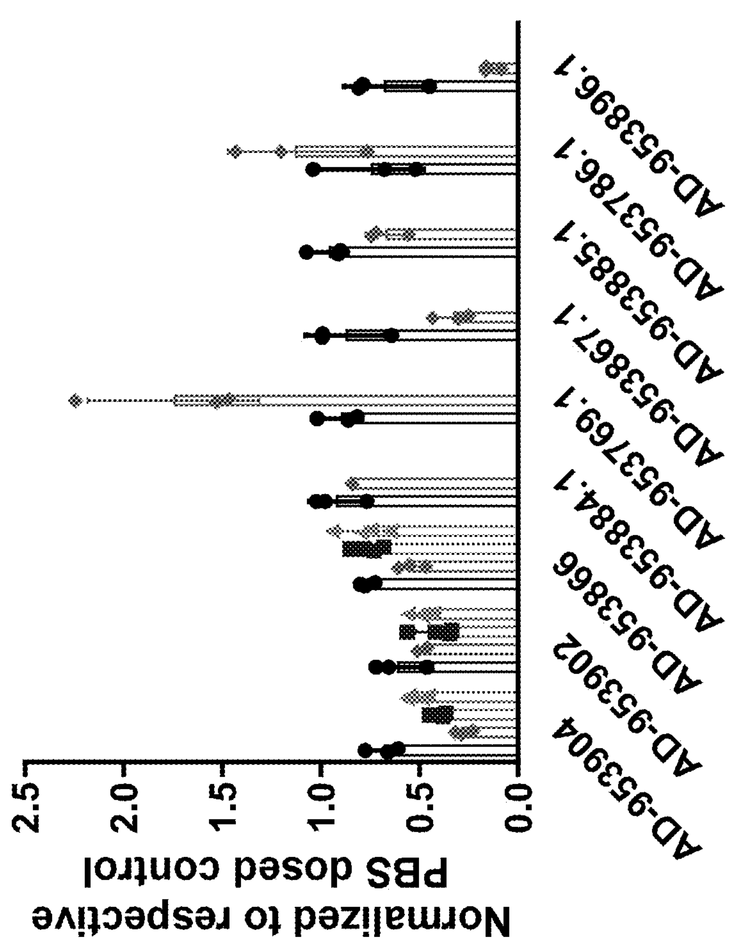
Figure 13B:
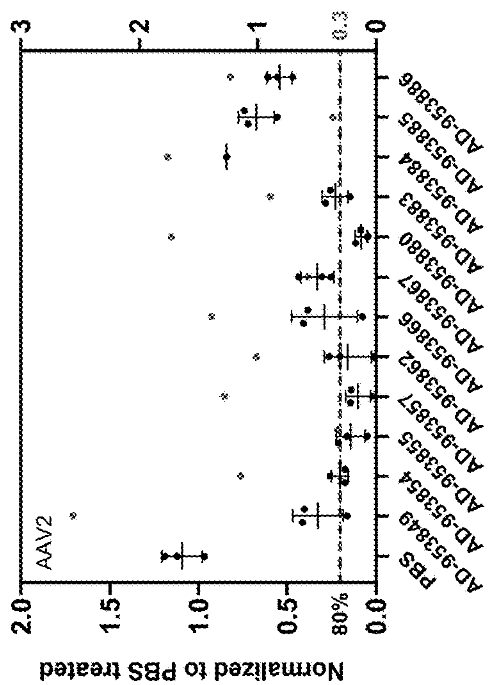
Figure 13D:
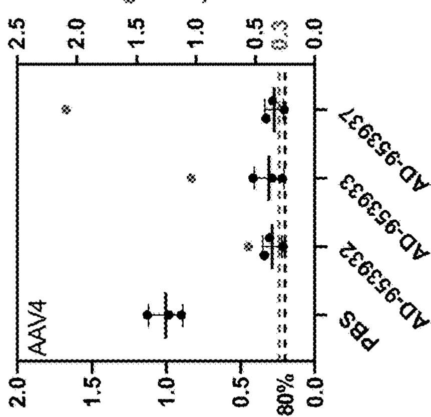
Figure 13A:
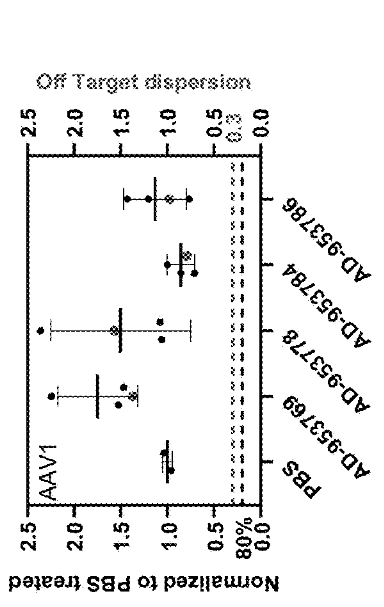
Figure 13C:
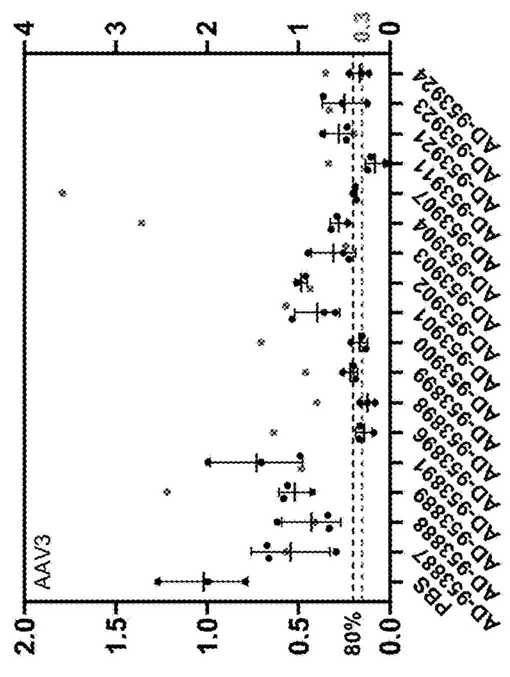

FIG. 12 is a graph showing full-length mutant human HTT mRNA levels in the livers of YAC 128 mice or wildtype mice expressing a portion of human wild-type HTT ("AAV") and subcutaneously administered a single dose of the indicated dsRNA duplexes targeting the full length HTT transcript at the indicated days post dose. HTT levels shown are normalized to PBS treatment levels.

FIGS. 13A-D are graphs showing full-length human HTT mRNA levels in the livers of mice expressing a portion of human wild-type HTT via AAV. These mice were subcutaneously administered a single 3 mg/kg dose of the indicated dsRNA duplexes targeting the full length HTT transcript at 14 days post-dose. HTT levels are shown relative to AAV treated control levels 14 days post siRNA dose.

DETAILED DESCRIPTION OF THE INVENTION

The present disclosure provides RNAi compositions, which effect the RNA-induced silencing complex (RISC)- mediated cleavage of RNA transcripts of a huntingtin (HTT) gene. The HTT gene may be within a cell, e.g., a cell within a subject, such as a human. The use of these iRNAs enables the targeted degradation of mRNAs of the corresponding gene (HTT gene) in mammals.

The iRNAs of the invention have been designed to target an HTT gene, including portions of the gene that are conserved in the HTT orthologs of other mammalian species. The iRNAs of the invention have also been designed to target a particular portion of an HTT gene, exon 1, e.g., thereby targeting the full-length wild-type transcript, the full-length mutant transcript, as well as the truncated mutant transcript. Without intending to be limited by theory, it is believed that a combination or sub-combination of the foregoing properties and the specific target sites, e.g., exon 1, or the specific modifications in these iRNAs confer to the iRNAs of the invention improved efficacy, stability, potency, durability, and safety.

Accordingly, the present disclosure also provides methods of using the RNAi compositions of the disclosure for inhibiting the expression of an HTT gene or for treating a subject having a disorder that would benefit from inhibiting or reducing the expression of an HTT gene, e.g., an HTT-associated diseases, for example, Huntington's disease (HD).

The RNAi agents of the disclosure include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an HTT gene. In certain embodiments, the RNAi agents of the disclosure include an RNA strand (the antisense strand) having a region which is about 21-23 nucleotides in length, which region is substantially complementary to at least part of an mRNA transcript of an HTT gene.

In certain embodiments, the RNAi agents of the disclosure include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of an HTT gene. These RNAi agents with the longer length antisense strands preferably include a second RNA strand (the sense strand) of 20-60 nucleotides in length wherein the sense and antisense strands form a duplex of 18-30 contiguous nucleotides.

The use of these RNAi agents enables the targeted degradation of mRNAs of an HTT gene in mammals. Thus, methods and compositions including these RNAi agents are useful for treating a subject who would benefit by a reduction in the levels or activity of an HTT protein, such as a subject having an HTT-associated disease, such as Huntington's disease (HD).

The following detailed description discloses how to make and use compositions containing RNAi agents to inhibit the expression of an HTT gene, as well as compositions and methods for treating subjects having diseases and disorders that would benefit from inhibition or reduction of the expression of the genes.

I. Definitions

In order that the present disclosure may be more readily understood, certain terms are first defined. In addition, it should be noted that whenever a value or range of values of a parameter are recited, it is intended that values and ranges intermediate to the recited values are also intended to be part of this disclosure.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to". The term "or" is used herein to mean, and is used interchangeably with, the term "and/or," unless context clearly indicates otherwise.

The term "about" is used herein to mean within the typical ranges of tolerances in the art. For example, "about" can be understood as about 2 standard deviations from the mean. In certain embodiments, about means ±10%. In certain embodiments, about means ±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a chemical structure and a chemical name, the chemical structure takes precedence.

The term "HTT" or "huntingtin", also known as "Huntingtin," "Huntington Disease Protein," "IT15," "HD," HD Protein," or "LOMARS," refers to the well-known gene that encodes the protein, HTT, that is widely expressed, required for normal development and the disease gene linked to Huntington's disease, a neurodegenerative disorder characterized by loss of striatal neurons caused by an expanded, unstable trinucleotide (CAG) repeat in the huntingtin gene, which translates as a polyglutamine repeat in the protein product.

Exemplary nucleotide and amino acid sequences of HTT can be found, for example, at GenBank Accession No. NM_002111.8 (*Homo sapiens* HTT, SEQ ID NO: 1, reverse complement, SEQ ID NO: 6); GenBank Accession No.

NM_010414.3 (*Mus musculus* HTT, SEQ ID NO: 2; reverse complement, SEQ ID NO: 7); GenBank Accession No.: NM_024357.3 (*Rattus norvegicus* HTT, SEQ ID NO: 3, reverse complement, SEQ ID NO: 8); GenBank Accession No.: XM_015449989.1 (*Macaca fascicularis* HTT, SEQ ID NO: 4, reverse complement, SEQ ID NO: 9); and GenBank Accession No.: XM_028848247.1 (*Macaca* mulatta HTT, SEQ ID NO: 5, reverse complement, SEQ ID NO: 10).

Additional examples of HTT sequences can be found in publically available databases, for example, GenBank, OMIM, and UniProt.

Further information on HTT can be found, for example, at www.ncbi.nlm.nih.gov/gene/3064.

The entire contents of each of the foregoing GenBank Accession numbers and the Gene database numbers are incorporated herein by reference as of the date of filing this application.

The term HTT, as used herein, also refers to variations of the HTT gene including variants provided in the SNP database. Numerous sequence variations within the HTT gene have been identified and may be found at, for example, NCBI dbSNP and UniProt (see, e.g., www.ncbi.nlm.nih.gov/snp/?LinkName=gene_snp&from_uid=3064, the entire contents of which is incorporated herein by reference as of the date of filing this application.

As used herein, "target sequence" refers to a contiguous portion of the nucleotide sequence of an mRNA molecule formed during the transcription of an HTT gene, including mRNA that is a product of RNA processing of a primary transcription product. In one embodiment, the target portion of the sequence will be at least long enough to serve as a substrate for RNAi-directed cleavage at or near that portion of the nucleotide sequence of an mRNA molecule formed during the transcription of an HTT gene.

The target sequence is about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In certain embodiments, the target sequence is 19-23 nucleotides in length, optionally 21-23 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature.

"G," "C," "A," "T", and "U" each generally stand for a nucleotide that contains guanine, cytosine, adenine, thymidine, and uracil as a base, respectively in the context of a modified or unmodified nucleotide. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, thymidine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the disclosure by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the disclosure.

The terms "iRNA", "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. RNA interference (RNAi) is a process that directs the sequence-specific degradation of mRNA. RNAi modulates, e.g., inhibits, the expression of HTT in a cell, e.g., a cell within a subject, such as a mammalian subject.

In one embodiment, an RNAi agent of the disclosure includes a single stranded RNAi that interacts with a target RNA sequence, e.g., an HTT target mRNA sequence, to direct the cleavage of the target RNA. Without wishing to be bound by theory it is believed that long double stranded RNA introduced into cells is broken down into double-stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the disclosure relates to a single stranded RNA (ssRNA) (the antisense strand of a siRNA duplex) generated within a cell and which promotes the formation of a RISC complex to effect silencing of the target gene, i.e., an HTT gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, a "RNAi agent" for use in the compositions and methods of the disclosure is a double stranded RNA and is referred to herein as a "double stranded RNAi agent," "double stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., an HTT gene. In some embodiments of the disclosure, a double stranded RNA (dsRNA) triggers the degradation of a target RNA, e.g., an mRNA, through a post-transcriptional gene-silencing mechanism referred to herein as RNA interference or RNAi.

In general, a dsRNA molecule can include ribonucleotides, but as described in detail herein, each or both strands can also include one or more non-ribonucleotides, e.g., a deoxyribonucleotide, a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the disclosure include all types of modifications disclosed herein or known in the art. Any such modifications, as used in a siRNA type molecule, are encompassed by "RNAi agent" for the purposes of this specification and claims.

In certain embodiments of the instant disclosure, inclusion of a deoxy-nucleotide if present within an RNAi agent can be considered to constitute a modified nucleotide.

The duplex region may be of any length that permits specific degradation of a desired target RNA through a RISC pathway, and may range from about 15-36 base pairs in length, for example, about 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 4, at least 5, at least 6, at least 7, at least 8, at least 9, at least 10, at least 20, at least 23 or more unpaired nucleotides or nucleotides not directed to the target site of the dsRNA. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not, but can be covalently connected. In certain embodiments where the two strands are connected covalently by means other than an uninterrupted chain of nucleotides between the 3'-end of one strand and the 5'-end of the respective other strand forming the duplex structure, the connecting structure is referred to as a "linker" (though it is noted that certain other structures defined elsewhere herein can also be referred to as a "linker"). The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, an RNAi agent of the disclosure is a dsRNA, each strand of which independently comprises 19-23 nucleotides, that interacts with a target RNA sequence, e.g., an HTT target mRNA sequence, to direct the cleavage of the target RNA.

As used herein, the term "nucleotide overhang" refers to at least one unpaired nucleotide that protrudes from the duplex structure of an RNAi agent, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the overhang on the sense strand or the antisense strand, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

In certain embodiments, at least one end of at least one strand is extended beyond a duplex targeting region, including structures where one of the strands includes a thermodynamically-stabilizing tetraloop structure (see, e.g., U.S. Pat. Nos. 8,513,207 and 8,927,705, as well as WO2010033225, the entire contents of each of which are incorporated by reference herein). Such structures may include single-stranded extensions (on one or both sides of the molecule) as well as double-stranded extensions.

In certain embodiments, the 3' end of the sense strand and the 5' end of the antisense strand are joined by a polynucleotide sequence comprising ribonucleotides, deoxyribonucleotides or both, optionally wherein the polynucleotide sequence comprises a tetraloop sequence. In certain embodiments, the sense strand is 25-35 nucleotides in length.

A tetraloop may contain ribonucleotides, deoxyribonucleotides, modified nucleotides, and combinations thereof. Typically, a tetraloop has 4 to 5 nucleotides. In some embodiments, the loop comprises a sequence set forth as GAAA. In some embodiments, at least one of the nucleotide of the loop (GAAA) comprises a nucleotide modification. In some embodiments, the modified nucleotide comprises a 2'-modification. In some embodiments, the 2 '-modification is a modification selected from the group consisting of 2'-aminoethyl, 2'-fluoro, 2'-O-methyl, 2'-O-methoxyethyl, 2'-aminodiethoxymethanol, 2'-adem, and 2'-deoxy-2'-fhioro-d-arabinonucleic acid. In some embodiments, all of the nucleotides of the loop are modified. In some embodiments, the G in the GAAA sequence comprises a 2'-OH. In some embodiments, each of the nucleotides in the GAAA sequence comprises a 2'-O-methyl modification. In some embodiments, each of the A in the GAAA sequence comprises a 2'-OH and the G in the GAAA sequence comprises a 2'-O-methyl modification. In preferred embodiments, In some embodiments, each of the A in the GAAA sequence comprises a 2'-O-methoxyethyl (MOE) modification and the G in the GAAA sequence comprises a 2'-O-methyl modification; or each of the A in the GAAA sequence comprises a 2'-adem modification and the G in the GAAA sequence comprises a 2'-O-methyl modification. See, e.g., PCT Publication No. WO 2020/206350, the entire contents of which are incorporated herein by reference.

An exemplary 2' adem modified nucleotide is shown below:

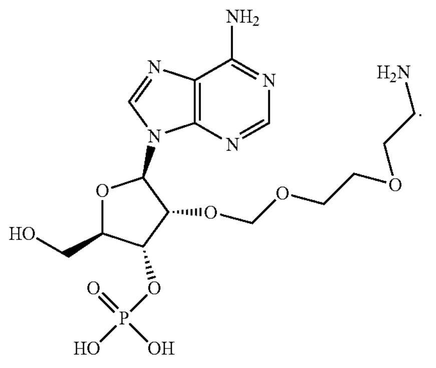 [SMILES: NCCOCCOCO[C@@H]1[C@H](OP(=O)(O)O)[C@@H](CO)O[C@H]1n1cnc2c(N)ncnc21]

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double stranded over its entire length.

The term "antisense strand" or "guide strand" refers to the strand of an RNAi agent, e.g., a dsRNA, which includes a region that is substantially complementary to a target sequence, e.g., an HTT mRNA.

As used herein, the term "region of complementarity" refers to the region on the antisense strand that is substantially complementary to a sequence, for example a target sequence, e.g., an HTT nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- or 3'-terminus of the RNAi agent. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(s) is not in the seed region.

Thus, an RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an HTT gene, generally does not contain any mismatch within the central 13 nucleotides. The methods described herein or methods known in the art can be used to determine whether an RNAi agent containing a mismatch to a target sequence is effective in inhibiting the expression of an HTT gene. Consideration of the efficacy of RNAi agents with mismatches in inhibiting expression of an HTT gene is important, especially if the particular region of complementarity in an HTT gene is known to have polymorphic sequence variation within the population.

The term "sense strand" or "passenger strand" as used herein, refers to the strand of an RNAi agent that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person.

Complementary sequences within an RNAi agent, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an RNAi agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding HTT). For example, a polynucleotide is complementary to at least a part of an HTT mRNA if the sequence is substantially complementary to a non-interrupted portion of an mRNA encoding HTT.

Accordingly, in some embodiments, the antisense polynucleotides disclosed herein are fully complementary to the target HTT sequence. In other embodiments, the antisense polynucleotides disclosed herein are substantially complementary to the target complement component HTT sequence and comprise a contiguous nucleotide sequence which is at least 80% complementary over its entire length to the equivalent region of the nucleotide sequence of any one of SEQ ID NOs:1-5, or a fragment of any one of SEQ ID NOs:1-5, such as about 85%, about 90%, about 91%, about 92%, about 93%, about 94%, about 95%, about 96%, about 97%, about 98%, or about 99% complementary.

In other embodiments, the antisense polynucleotides disclosed herein are substantially complementary to the target HTT sequence and comprise a contiguous nucleotide sequence which is at least about 80% complementary over its entire length to any one of the sense strand nucleotide sequences in any one of any one of Tables 2, 3, 5, 6, 8, 9, 11, 12, 14, 15, 17, 18, 20, 21, 24, 25, 27-30, 32 and 33, or a fragment of any one of the sense strand nucleotide sequences in any one of Tables 2, 3, 5, 6, 8, 9, 11, 12, 14, 15, 17, 18, 20, 21, 24, 25, 27-30, 32 and 33, such as about 85%, about 90%, about 91%, about 92%, about 93%, about 94%, about 95%, about 96%, about 97%, about 98%, about 99%, or 100% complementary.

In one embodiment, an RNAi agent of the disclosure includes a sense strand that is substantially complementary to an antisense polynucleotide which, in turn, is the same as a target HTT sequence, and wherein the sense strand polynucleotide comprises a contiguous nucleotide sequence which is at least about 80% complementary over its entire length to the equivalent region of the nucleotide sequence of SEQ ID NOs: 6-10, or a fragment of any one of SEQ ID NOs:6-10, such as about 85%, about 90%, about 91%, about 92%, about 93%, about 94%, about 95%, about 96%, about 97%, about 98%, about 99%, or 100% complementary.

In some embodiments, an iRNA of the invention includes a sense strand that is substantially complementary to an antisense polynucleotide which, in turn, is complementary to a target HTT sequence, and wherein the sense strand polynucleotide comprises a contiguous nucleotide sequence which is at least about 80% complementary over its entire length to any one of the antisense strand nucleotide sequences in any one of any one of Tables 2, 3, 5, 6, 8, 9, 11, 12, 14, 15, 17, 18, 20, 21, 24, 25, 27-30, 32 and 33, or a fragment of any one of the antisense strand nucleotide sequences in any one of Tables 2, 3, 5, 6, 8, 9, 11, 12, 14, 15, 17, 18, 20, 21, 24, 25, 27-30, 32 and 33, such as about 85%, about 90%, about 91%, about 92%, about 93%, about 94%, about 95%, about 96%, about 97%, about 98%, about 99%, or 100% complementary In one embodiment, at least partial suppression of the expression of an HTT gene, is assessed by a reduction of the amount of HTT mRNA which can be isolated from or detected in a first cell or group of cells in which an HTT gene is transcribed and which has or have been treated such that the expression of an HTT gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an RNAi agent," such as a dsRNA, as used herein, includes contacting a cell by any possible means. Contacting a cell with an RNAi agent includes contacting a cell in vitro with the RNAi agent or contacting a cell in vivo with the RNAi agent. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the central nervous system (CNS), optionally via intrathecal, intravitreal or other injection, or to the bloodstream or the subcutaneous space, such that the agent will subsequently reach the tissue where the cell to be contacted is located. For example, the RNAi agent may contain or be coupled to a ligand, e.g., a lipophilic moiety or moieties as described below and further detailed, e.g., in PCT/US2019/031170, which is incorporated herein by reference, that directs or otherwise stabilizes the RNAi agent at a site of interest, e.g., the CNS. Combinations of in vitro and in vivo methods of contacting are also possible. For example, a cell may also be contacted in vitro with an RNAi agent and subsequently transplanted into a subject.

In one embodiment, contacting a cell with an RNAi agent includes "introducing" or "delivering the RNAi agent into the cell" by facilitating or effecting uptake or absorption into the cell. Absorption or uptake of an RNAi agent can occur through unaided diffusive or active cellular processes, or by auxiliary agents or devices. Introducing an RNAi agent into a cell may be in vitro or in vivo. For example, for in vivo introduction, an RNAi agent can be injected into a tissue site or administered systemically. In vitro introduction into a cell includes methods known in the art such as electroporation and lipofection. Further approaches are described herein below or are known in the art.

The term "lipophile" or "lipophilic moiety" broadly refers to any compound or chemical moiety having an affinity for lipids. One way to characterize the lipophilicity of the lipophilic moiety is by the octanol-water partition coefficient, log $K_{ow}$, where $K_{ow}$ is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., *J. Chem. Inf. Comput. Sci.* 41:1407-21 (2001), which is incorporated herein by reference in its entirety). It provides a thermodynamic measure of the tendency of the substance to prefer a non-aqueous or oily milieu rather than water (i.e. its hydrophilic/lipophilic balance). In principle, a chemical substance is lipophilic in character when its log $K_{ow}$ exceeds 0. Typically, the lipophilic moiety possesses a log $K_{ow}$ exceeding 1, exceeding 1.5, exceeding 2, exceeding 3, exceeding 4, exceeding 5, or exceeding 10. For instance, the log $K_{ow}$ of 6-amino hexanol, for instance, is predicted to be approximately 0.7. Using the same method, the log $K_{ow}$ of cholesteryl N-(hexan-6-ol) carbamate is predicted to be 10.7.

The lipophilicity of a molecule can change with respect to the functional group it carries. For instance, adding a hydroxyl group or amine group to the end of a lipophilic moiety can increase or decrease the partition coefficient (e.g., log $K_{ow}$) value of the lipophilic moiety.

Alternatively, the hydrophobicity of the double-stranded RNAi agent, conjugated to one or more lipophilic moieties, can be measured by its protein binding characteristics. For instance, in certain embodiments, the unbound fraction in the plasma protein binding assay of the double-stranded RNAi agent could be determined to positively correlate to the relative hydrophobicity of the double-stranded RNAi agent, which could then positively correlate to the silencing activity of the double-stranded RNAi agent.

In one embodiment, the plasma protein binding assay determined is an electrophoretic mobility shift assay (EMSA) using human serum albumin protein. An exemplary protocol of this binding assay is illustrated in detail in, e.g., PCT/US2019/031170. The hydrophobicity of the double-stranded RNAi agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded RNAi agent provides optimal hydrophobicity for the enhanced in vivo delivery of siRNA.

The term "lipid nanoparticle" or "LNP" is a vesicle comprising a lipid layer encapsulating a pharmaceutically active molecule, such as a nucleic acid molecule, e.g., a rNAi agent or a plasmid from which an RNAi agent is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), or a non-primate (such as a rat, or a mouse). In a preferred embodiment, the subject is a human, such as a human being treated or assessed for a disease, disorder, or condition that would benefit from reduction in HTT expression; a human at risk for a disease, disorder, or condition that would benefit from reduction in HTT expression; a human having a disease, disorder, or condition that would benefit from reduction in HTT expression; or human being treated for a disease, disorder, or condition that would benefit from reduction in HTT expression as described herein. In some embodiments, the subject is a female human. In other embodiments, the subject is a male human. In one embodiment, the subject is an adult subject. In one embodiment, the subject is a pediatric subject. In another embodiment, the subject is a juvenile subject, i.e., a subject below 20 years of age.

As used herein, the terms "treating" or "treatment" refer to a beneficial or desired result including, but not limited to, alleviation or amelioration of one or more signs or symptoms associated with HTT gene expression or HTT protein production, e.g., HTT-associated diseases, such as Huntington's disease. "Treatment" can also mean prolonging survival as compared to expected survival in the absence of treatment.

The term "lower" in the context of the level of HTT in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of HTT in a subject is preferably down to a level accepted as within the range of normal for an individual without such disorder. In certain embodiments, "lower" is the decrease in the difference between the level of a marker or symptom for a subject suffering from a disease and a level accepted within the range of normal for an individual, e.g., the level of decrease in bodyweight between an obese individual and an individual having a weight accepted within the range of normal.

As used herein, "prevention" or "preventing," when used in reference to a disease, disorder, or condition thereof, that would benefit from a reduction in expression of an HTT gene or production of an HTT protein, refers to a reduction in the likelihood that a subject will develop a symptom associated with such a disease, disorder, or condition, e.g., a symptom of an HTT-associated disease. The failure to develop a disease, disorder, or condition, or the reduction in the development of a symptom associated with such a disease, disorder, or condition (e.g., by at least about 10% on a clinically accepted scale for that disease or disorder), or the exhibition of delayed symptoms delayed (e.g., by days, weeks, months or years) is considered effective prevention.

As used herein, the term "HTT-associated disease" or "HTT-associated disorder" is understood as any disease or disorder that would benefit from reduction in the expression and/or activity of HTT. Exemplary HTT-associated diseases include Huntington's disease.

"Huntington's disease," also known as HD, Huntington's Chorea, Chorea Major, Chronic Progressive Chorea, and Hereditary Chorea, is an autosomal dominant genetic disorder characterized by choreiform movements and progressive intellectual deterioration, usually beginning in middle age (35 to 50 yr). The disease affects both sexes equally. The caudate nucleus atrophies, the small-cell population degenerates, and levels of the neurotransmitters gamma-aminobutyric acid (GAB A) and substance P decrease. This degeneration results in characteristic "boxcar ventricles" seen on CT scans. Symptoms and signs of HD develop insidiously. HD's most obvious symptoms are abnormal body movements called chorea and lack of coordination, but it also affects a number of mental abilities and some aspects of personality. These physical symptoms commonly become noticeable in a person's forties, but can occur at any age. If the age of onset is below 20 years then it is known as Juvenile HD.

Dementia or psychiatric disturbances, ranging from apathy and irritability to full-blown bipolar or schizophreniform disorder, may precede the movement disorder or develop during its course. Anhedonia or asocial behavior may be the first behavioral manifestation. Motor manifestations include flicking movements of the extremities, a lilting gait, motor inpersistence (inability to sustain a motor act, such as tongue protrusion), facial grimacing, ataxia, and dystonia.

HD is caused by a trinucleotide repeat expansion in the Huntingtin (HTT) gene, and is one of several polyglutamine expansion (or PolyQ expansion) diseases. This produces an extended form of the mutant Huntingtin protein (mHtt), which causes cell death in selective areas of the brain.

"Therapeutically effective amount," as used herein, is intended to include the amount of an RNAi agent that, when administered to a subject having an HTT-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having an HTT-associated disorder, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired local or systemic effect at a reasonable benefit/risk ratio applicable to any treatment. An RNAi agent employed in the methods of the present disclosure may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the brain (e.g., whole brain or certain segments of brain, e.g., striatum, or certain types of cells in the brain, such as, e.g., neurons and glial cells (astrocytes, oligodendrocytes, microglial cells)). In some embodiments, a "sample derived from a subject" refers to blood drawn from the subject or plasma or serum derived therefrom. In further embodiments, a "sample derived from a subject" refers to brain tissue (or subcomponents thereof) or retinal tissue (or subcomponents thereof) derived from the subject.

II. RNAi Agents of the Disclosure

Described herein are RNAi agents which inhibit the expression of an HTT gene. In one embodiment, the RNAi agent includes double stranded ribonucleic acid (dsRNA) molecules for inhibiting the expression of an HTT gene in a cell, such as a cell within a subject, e.g., a mammal, such as a human having an HTT-associated disease, e.g., Huntington's disease. The dsRNA includes an antisense strand having a region of complementarity which is complementary to at least a part of an mRNA formed in the expression of an HTT gene, The region of complementarity is about 15-30 nucleotides or less in length. Upon contact with a cell expressing the HTT gene, the RNAi agent inhibits the expression of the HTT gene (e.g., a human gene, a primate gene, a non-primate gene) by at least 50% as assayed by, for example, a PCR or branched DNA (bDNA)-based method, or by a protein-based method, such as by immunofluorescence analysis, using, for example, western blotting or flow cytometric techniques. In one, the level of knockdown is assayed in Cos 7 cells using a Dual-Luciferase assay method.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an HTT gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain preferred embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is 15 to 23 nucleotides in length, 19 to 23 nucleotides in length, or 25 to 30 nucleotides in length. In general, the dsRNA is long enough to serve as a substrate for the Dicer enzyme. For example, it is well known in the art that dsRNAs longer than about 21-23 nucleotides can serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 15 to 36 base pairs, e.g., 15-36, 15-35, 15-34, 15-33, 15-32, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs, for example, 19-21 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an RNAi agent useful to target HTT expression is not generated in the target cell by cleavage of a larger dsRNA.

A dsRNA as described herein can further include one or more single-stranded nucleotide overhangs e.g., 1, 2, 3, or 4 nucleotides. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In one aspect, a dsRNA of the disclosure includes at least two nucleotide sequences, a sense sequence and an antisense sequence. The sense strand sequence for HTT may be selected from the group of sequences provided in any one of Tables 2, 3, 5, 6, 8, 9, 11, 12, 14, 15, 17, 18, 20, 21, 24, 25, 27-30, 32 and 33, and the corresponding nucleotide sequence of the antisense strand of the sense strand may be selected from the group of sequences of any one of Tables 2, 3, 5, 6, 8, 9, 11, 12, 14, 15, 17, 18, 20, 21, 24, 25, 27-30, 32 and 33. In this aspect, one of the two sequences is complementary to the other of the two sequences, with one of the sequences being substantially complementary to a sequence of an mRNA generated in the expression of an HTT gene. As such, in this aspect, a dsRNA will include two oligonucleotides, where one oligonucleotide is described as the sense strand (passenger strand) in any one of Tables 2, 3, 5, 6, 8, 9, 11, 12, 14, 15, 17, 18, 20, 21, 24, 25, 27-30, 32 and 33, and the second oligonucleotide is described as the corresponding antisense strand (guide strand) of the sense strand in any one of Tables 2, 3, 5, 6, 8, 9, 11, 12, 14, 15, 17, 18, 20, 21, 24, 25, 27-30, 32 and 33.

In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in Tables 2, 3, 5, 6, 8, 9, 11, 12, 14, 15, 17, 18, 20, 21, 24, 25, 27-30, 32 and 33 are described as modified or conjugated sequences, the RNA of the RNAi agent of the disclosure e.g., a dsRNA of the disclosure, may comprise any one of the sequences set forth in any one of Tables 2, 3, 5, 6, 8, 9, 11, 12, 14, 15, 17, 18, 20, 21, 24, 25, 27-30, 32 and 33 that is un-modified, un-conjugated, or modified or conjugated differently than described therein. For example, although the sense strands of the agents of the invention shown in Tables 3, 9, 12, 15, 17, 27, 29 and 32 are conjugated to a GalNAc ligand, these agents may be conjugated to a moiety that directs delivery to the CNS, e.g., a C16 ligand, as described herein. A lipophilic ligand can be included in any of the positions provided in the instant application.

The skilled person is well aware that dsRNAs having a duplex structure of about 20 to 23 base pairs, e.g., 21, base pairs have been hailed as particularly effective in inducing RNA interference (Elbashir et al., (2001) *EMBO J.,* 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided herein, dsRNAs described herein can include at least one strand of a length of minimally 21 nucleotides. It can be reasonably expected that shorter duplexes minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of an HTT gene by not more than 10, 15, 20, 25, or 30% inhibition from a dsRNA comprising the full sequence using the in vitro assay with Cos 7 and a 10 nM concentration of the RNA agent and the PCR assay as provided in the examples herein, are contemplated to be within the scope of the present disclosure.

In addition, the RNAs described herein identify a site(s) in an HTT transcript that is susceptible to RISC-mediated cleavage. As such, the present disclosure further features RNAi agents that target within this site(s). As used herein, an RNAi agent is said to target within a particular site of an RNA transcript if the RNAi agent promotes cleavage of the transcript anywhere within that particular site. Such an RNAi agent will generally include at least about 15 contiguous nucleotides, preferably at least 19 nucleotides, from one of the sequences provided herein coupled to additional nucleotide sequences taken from the region contiguous to the selected sequence in an HTT gene.

III. Modified RNAi Agents of the Disclosure

In one embodiment, the RNA of the RNAi agent of the disclosure e.g., a dsRNA, is un-modified, and does not comprise, e.g., chemical modifications or conjugations known in the art and described herein. In preferred embodiments, the RNA of an RNAi agent of the disclosure, e.g., a dsRNA, is chemically modified to enhance stability or other beneficial characteristics. In certain embodiments of the disclosure, substantially all of the nucleotides of an RNAi agent of the disclosure are modified. In other embodiments of the disclosure, all of the nucleotides of an RNAi agent of the disclosure are modified. RNAi agents of the disclosure in which "substantially all of the nucleotides are modified" are largely but not wholly modified and can include not more than 5, 4, 3, 2, or unmodified nucleotides. In still other embodiments of the disclosure, RNAi agents of the disclosure can include not more than 5, 4, 3, 2 or 1 modified nucleotides.

The nucleic acids featured in the disclosure can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of RNAi agents useful in the embodiments described herein include, but are not limited to, RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified RNAi agent will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in RNAi agents, in which both the sugar and the internucleoside linkage, i.e., the backbone, of the nucleotide units are replaced with novel groups. The base units are maintained for hybridization with an appropriate nucleic acid target compound. One such oligomeric compound, a RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the RNAi agents of the disclosure are described in, for example, in Nielsen et al., *Science,* 1991, 254, 1497-1500.

Some embodiments featured in the disclosure include RNAs with phosphorothioate backbones and oligonucleosides with heteroatom backbones, and in particular $—CH_2—NH—CH_2—$, $—CH_2—N(CH_3)—O—CH_2—$[known as a methylene (methylimino) or MMI backbone], $—CH_2—O—N(CH_3)—CH_2—$, $—CH_2—N(CH_3)—N(CH_3)—CH_2—$ and $—N(CH_3)—CH_2—CH_2—$[wherein the native phosphodiester backbone is represented as $—O—P—O—CH_2—$] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The RNAi agents, e.g., dsRNAs, featured herein can include one of the following at the 2'-position: OH; F; O—, S—, or N-alkyl; O—, S—, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an RNAi agent, or a group for improving the pharmacodynamic properties of an RNAi agent, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_2)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$), 2'-O-hexadecyl, and 2'-fluoro (2'-F). Similar modifications can also be made at other positions on the RNA of an RNAi agent, particularly the 3' position of the sugar on the 3' terminal nucleotide or in 2'-5' linked dsRNAs and the 5' position of 5' terminal nucleotide. RNAi agents can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An RNAi agent of the disclosure can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) *Angewandte Chemie, International Edition,* 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the disclosure. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

An RNAi agent of the disclosure can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

An RNAi agent of the disclosure can also be modified to include one or more bicyclic sugar moities. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the disclosure may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the disclosure include without limitation nucleosides comprising a bridge between the 4' and the 2' ribosyl ring atoms. In certain embodiments, the antisense polynucleotide agents of the disclosure include one or more bicyclic nucleosides comprising a 4' to 2' bridge. Examples of such 4' to 2' bridged bicyclic nucleosides, include but are not limited to 4'-(CH2)—O-2' (LNA); 4'-(CH2)—S-2'; 4'—(CH2)2-O-2' (ENA); 4'-CH(CH3)—O-2' (also referred to as "constrained ethyl" or "cEt") and 4'-CH(CH2OCH3)—O-2' (and analogs thereof; see, e.g., U.S. Pat. No. 7,399,845); 4'-C(CH3)(CH3)—O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.,* 2009, 74, 118-134); and 4'-CH2-C(═CH2)-2' (and analogs thereof; see, e.g., U.S. Pat. No.

8,278,426). The entire contents of each of the foregoing are hereby incorporated herein by reference.

Additional representative US patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

An RNAi agent of the disclosure can also be modified to include one or more constrained ethyl nucleotides. As used herein, a "constrained ethyl nucleotide" or "cEt" is a locked nucleic acid comprising a bicyclic sugar moiety comprising a 4'-CH(CH3)—O-2' bridge. In one embodiment, a constrained ethyl nucleotide is in the S conformation referred to herein as "S-cEt."

An RNAi agent of the disclosure may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US 2013/0190383; and WO 2013/036868, the entire contents of each of which are hereby incorporated herein by reference.

In some embodiments, an RNAi agent of the disclosure comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in WO 2011/005861.

Other modifications of an RNAi agent of the disclosure include a 5' phosphate or 5' phosphate mimic, e.g., a 5'-terminal phosphate or phosphate mimic on the antisense strand of an RNAi agent. Suitable phosphate mimics are disclosed in, for example US 2012/0157511, the entire contents of which are incorporated herein by reference.

A. Modified RNAi Agents Comprising Motifs of the Disclosure

In certain aspects of the disclosure, the double-stranded RNAi agents of the disclosure include agents with chemical modifications as disclosed, for example, in WO 2013/075035, the entire contents of which are incorporated herein by reference. As shown herein and in WO 2013/075035, a superior result may be obtained by introducing one or more motifs of three identical modifications on three consecutive nucleotides into a sense strand or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense or antisense strand. The RNAi agent may be optionally conjugated with a lipophilic ligand, e.g., a C16 ligand, for instance on the sense strand. The RNAi agent may be optionally modified with a (S)-glycol nucleic acid (GNA) modification, for instance on one or more residues of the antisense strand. The resulting RNAi agents present superior gene silencing activity.

Accordingly, the disclosure provides double stranded RNAi agents capable of inhibiting the expression of a target gene (i.e., an HTT gene) in vivo. The RNAi agent comprises a sense strand and an antisense strand. Each strand of the RNAi agent may be 15-30 nucleotides in length. For example, each strand may be 16-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length. In certain embodiments, each strand is 19-23 nucleotides in length.

The sense strand and antisense strand typically form a duplex double stranded RNA ("dsRNA"), also referred to herein as an "RNAi agent." The duplex region of an RNAi agent may be 15-30 nucleotide pairs in length. For example, the duplex region can be 16-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length. In preferred embodiments, the duplex region is 19-21 nucleotide pairs in length.

In one embodiment, the RNAi agent may contain one or more overhang regions or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In preferred embodiments, the nucleotide overhang region is 2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-O-methyl, thymidine (T), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5' end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (e.g., a lipophilic ligand, optionally a C16 ligand).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ‘ terminal nucleotide of antisense strand is unpaired with sense strand, and up to 6 consecutive 3’ terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1~4 nucleotides longer at its 3' end than the first strand, wherein the duplex region region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand.

For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two, or three nucleotides in the duplex region.

In one embodiment, the RNAi agent comprises mismatch (es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense or antisense strand.

In one embodiment, the sense strand sequence may be represented by formula (I):

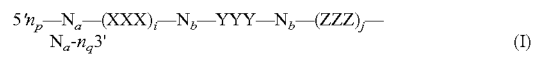

$$5' n_p\text{—}N_a\text{—}(XXX)_i\text{—}N_b\text{—}YYY\text{—}N_b\text{—}(ZZZ)_j\text{—}N_a\text{-}n_q 3' \quad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein $N_b$ and Y do not have the same modification; and

XXX, YYY and ZZZ each independently represent one motif of three identical modifications on three consecutive nucleotides. Preferably YYY is all 2'-F modified nucleotides.

In one embodiment, the $N_a$ or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the 1st nucleotide, from the 5'-end; or optionally, the count starting at the 1st paired nucleotide within the duplex region, from the 5'-end.

In one embodiment, i is 1 and j is 0, or i is 0 and j is 1, or both i and j are 1. The sense strand can therefore be represented by the following formulas:

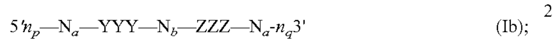
$$5'n_p\text{—}N_a\text{—}YYY\text{—}N_b\text{—}ZZZ\text{—}N_a\text{-}n_q3' \quad \text{(Ib);}$$

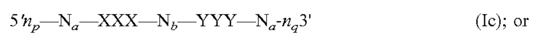
$$5'n_p\text{—}N_a\text{—}XXX\text{—}N_b\text{—}YYY\text{—}N_a\text{-}n_q3' \quad \text{(Ic); or}$$

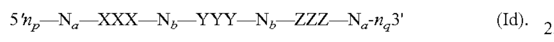
$$5'n_p\text{—}N_a\text{—}XXX\text{—}N_b\text{—}YYY\text{—}N_b\text{—}ZZZ\text{—}N_a\text{-}n_q3' \quad \text{(Id).}$$

When the sense strand is represented by formula (Ib), $N_b$ represents an oligonucleotide sequence comprising 0-10, 0-7, 0-5, 0-4, 0-2 or 0 modified nucleotides.

Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

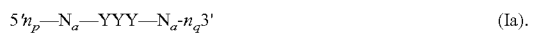
$$5'n_p\text{—}N_a\text{—}YYY\text{—}N_a\text{-}n_q3' \quad \text{(Ia).}$$

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

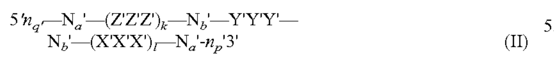
$$5'n_{q'}\text{—}N_a'\text{—}(Z'Z'Z')_k\text{—}N_b'\text{—}Y'Y'Y'\text{—}N_b'\text{—}(X'X'X')_l\text{—}N_a'\text{-}n_p'3' \quad \text{(II)}$$

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the 1st nucleotide, from the 5'-end; or optionally, the count starting at the 1st paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

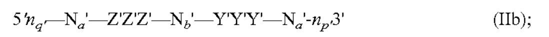
$$5'n_{q'}\text{—}N_a'\text{—}Z'Z'Z'\text{—}N_b'\text{—}Y'Y'Y'\text{—}N_a'\text{-}n_{p'}3' \quad \text{(IIb);}$$

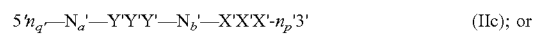
$$5'n_{q'}\text{—}N_a'\text{—}Y'Y'Y'\text{—}N_b'\text{—}X'X'X'\text{-}n_p'3' \quad \text{(IIc); or}$$

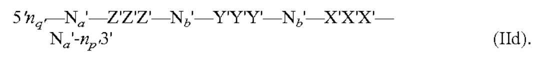
$$5'n_{q'}\text{—}N_a'\text{—}Z'Z'Z'\text{—}N_b'\text{—}Y'Y'Y'\text{—}N_b'\text{—}X'X'X'\text{—}N_a'\text{-}n_{p'}3' \quad \text{(IId).}$$

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

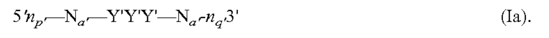
$$5'n_{p'}\text{—}N_{a'}\text{—}Y'Y'Y'\text{—}N_{a'}\text{-}n_{q'}3' \quad \text{(Ia).}$$

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1st nucleotide from the 5'-end, or optionally, the count starting at the 1st paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the $1^{st}$ nucleotide from the 5'-end, or optionally, the count starting at the $1^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the disclosure may comprise a sense strand and an antisense strand, each strand having 14 to 30 nucleotides, the RNAi duplex represented by formula (III):

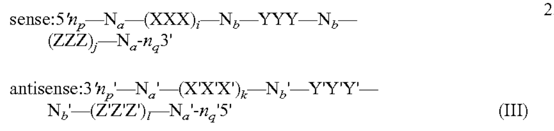

$$\text{sense:}5'n_p\text{—}N_a\text{—}(XXX)_i\text{—}N_b\text{—}YYY\text{—}N_b\text{—}(ZZZ)_j\text{—}N_a\text{-}n_q3'$$

$$\text{antisense:}3'n_p'\text{—}N_a'\text{—}(X'X'X')_k\text{—}N_b'\text{—}Y'Y'Y'\text{—}N_b'\text{—}(Z'Z'Z')_l\text{—}N_a'\text{-}n_q'5' \quad \text{(III)}$$

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides; wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an RNAi duplex include the formulas below:

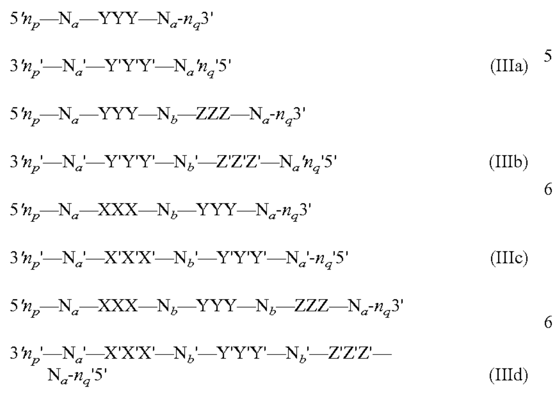

$$5'n_p\text{—}N_a\text{—}YYY\text{—}N_a\text{-}n_q3'$$

$$3'n_p'\text{—}N_a'\text{—}Y'Y'Y'\text{—}N_a'n_q'5' \quad \text{(IIIa)}$$

$$5'n_p\text{—}N_a\text{—}YYY\text{—}N_b\text{—}ZZZ\text{—}N_a\text{-}n_q3'$$

$$3'n_p'\text{—}N_a'\text{—}Y'Y'Y'\text{—}N_b'\text{—}Z'Z'Z'\text{—}N_a'n_q'5' \quad \text{(IIIb)}$$

$$5'n_p\text{—}N_a\text{—}XXX\text{—}N_b\text{—}YYY\text{—}N_a\text{-}n_q3'$$

$$3'n_p'\text{—}N_a'\text{—}X'X'X'\text{—}N_b'\text{—}Y'Y'Y'\text{—}N_a'\text{-}n_q'5' \quad \text{(IIIc)}$$

$$5'n_p\text{—}N_a\text{—}XXX\text{—}N_b\text{—}YYY\text{—}N_b\text{—}ZZZ\text{—}N_a\text{-}n_q3'$$

$$3'n_p'\text{—}N_a'\text{—}X'X'X'\text{—}N_b'\text{—}Y'Y'Y'\text{—}N_b'\text{—}Z'Z'Z'\text{—}N_a\text{-}n_q'5' \quad \text{(IIId)}$$

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-10, 0-7, 0-5, 0-4, 0-2 or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b'$ independently comprises modifications of alternating pattern.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more C16 (or related) moieties attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more lipophilic, e.g., C16 (or related) moieties, optionally attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more lipophilic, e.g., C16 (or related) moieties attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the disclosure. Such publications include WO2007/091269, WO2010/141511, WO2007/117686, WO2009/014887, and WO2011/031520; and U.S. Pat. No. 7,858,769, the entire contents of each of which are hereby incorporated herein by reference.

In certain embodiments, the compositions and methods of the disclosure include a vinyl phosphonate (VP) modification of an RNAi agent as described herein. In exemplary embodiments, a vinyl phosphonate of the disclosure has the following structure:

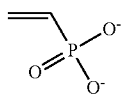

A vinyl phosphonate of the instant disclosure may be attached to either the antisense or the sense strand of a dsRNA of the disclosure. In certain preferred embodiments, a vinyl phosphonate of the instant disclosure is attached to the antisense strand of a dsRNA, optionally at the 5' end of the antisense strand of the dsRNA.

Vinyl phosphate modifications are also contemplated for the compositions and methods of the instant disclosure. An exemplary vinyl phosphate structure is:

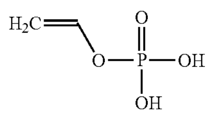

i. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand) to reduce or inhibit off-target gene silencing. It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, or preferably positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. The term "thermally destabilizing modification(s)" includes modification(s) that would result with a dsRNA with a lower overall melting temperature (Tm) (preferably a Tm with one, two, three or four degrees lower than the Tm of the dsRNA without having such modification(s). In some embodiments, the thermally destabilizing modification of the duplex is located at position 2, 3, 4, 5 or 9 from the 5'-end of the antisense strand.

The thermally destabilizing modifications can include, but are not limited to, abasic modification; mismatch with the opposing nucleotide in the opposing strand; and sugar modification such as 2'-deoxy modification or acyclic nucleotide, e.g., unlocked nucleic acids (UNA) or glycol nucleic acid (GNA).

Exemplified abasic modifications include, but are not limited to the following:

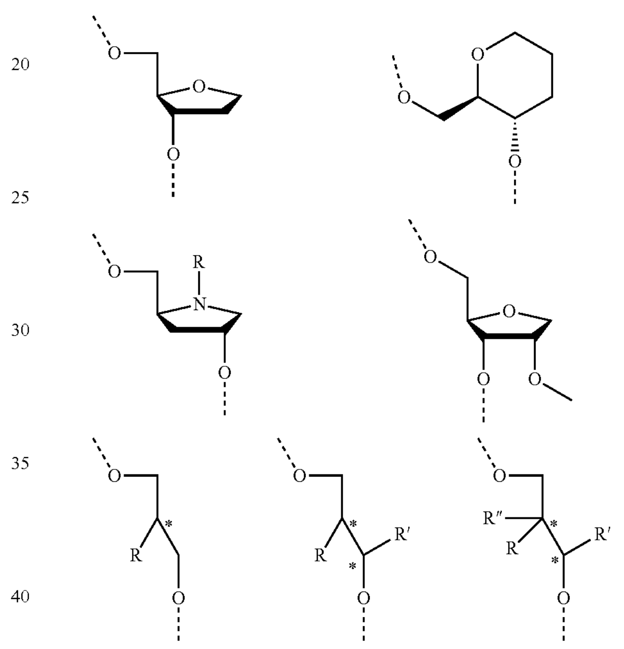

Wherein R=H, Me, Et or OMe; R'=H, Me, Et or OMe; R"=H, Me, Et or OMe

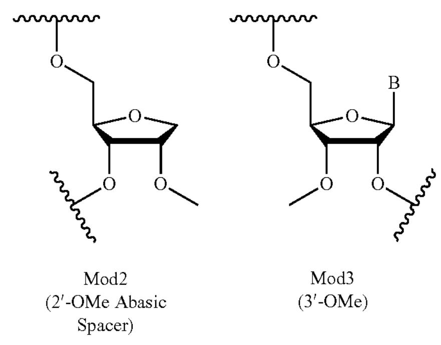

Mod2
(2'-OMe Abasic Spacer)

Mod3
(3'-OMe)

-continued

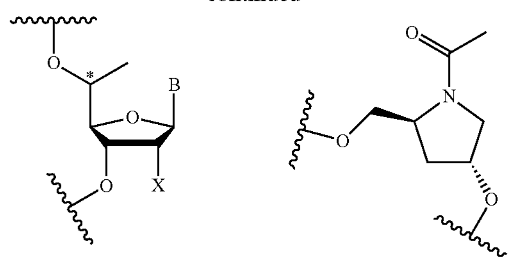

Mod4
(5′-Me)

Mod5
(Hyp-spacer)

X = OMe, F wherein B is a modified or unmodified nucleobase.

Exemplified sugar modifications include, but are not limited to the following:

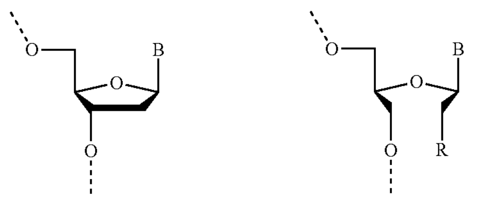

2′-deoxy unlocked nucleic acid
R = H, OH, O-alkyl

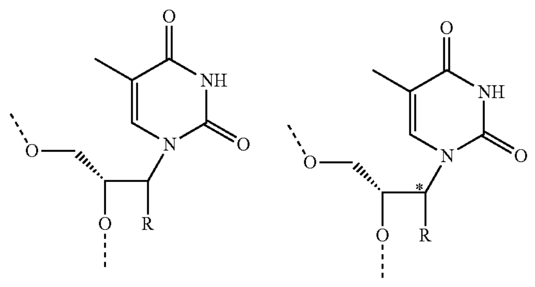

glycol nucleic acid
R = H, OH, O-alkyl glycol nucleic acid
R = H, OH, O-alkyl

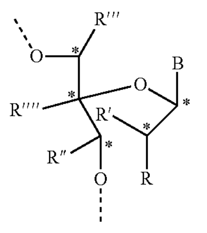

unlocked nucleic acid
R = H, OH, $CH_3$, $CH_2CH_3$, O-alkyl, $NH_2$, NHMe, $NMe_2$
R′ = H, OH, $CH_3$, $CH_2CH_3$, O-alkyl, $NH_2$, NHMe, $NMe_2$
R″ = H, OH, $CH_3$, $CH_2CH_3$, O-alkyl, $NH_2$, NHMe, $NMe_2$
R‴ = H, OH, $CH_3$, $CH_2CH_3$, O-alkyl, $NH_2$, NHMe, $NMe_2$
R⁗ = H, OH, $CH_3$, $CH_2CH_3$, O-alkyl, $NH_2$, NHMe, $NMe_2$ -continued

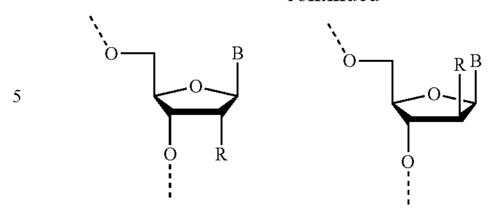

R = H, methyl, ethyl wherein B is a modified or unmodified nucleobase.

In some embodiments the thermally destabilizing modification of the duplex is selected from the group consisting of:

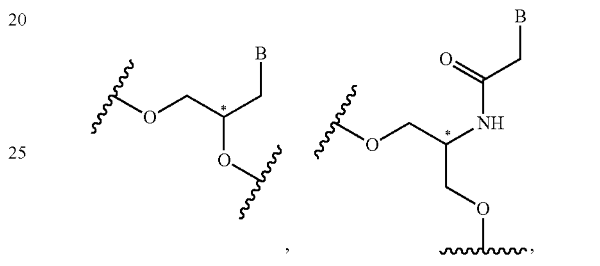

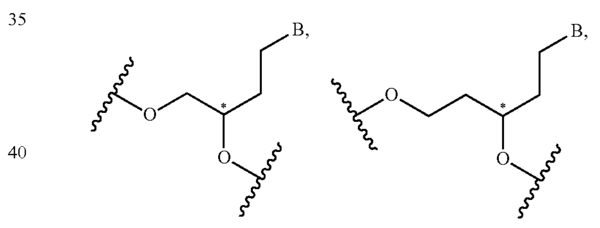

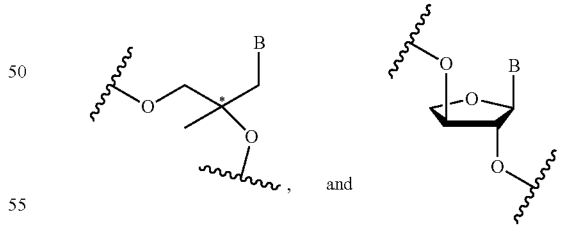

wherein B is a modified or unmodified nucleobase and the asterisk on each structure represents either R, S or racemic.

The term "acyclic nucleotide" refers to any nucleotide having an acyclic ribose sugar, for example, where any of bonds between the ribose carbons (e.g., C1'-C2', C2'-C3', C3'-C4', C4'—O4', or C1'—O4') is absent or at least one of ribose carbons or oxygen (e.g., C1', C2', C3', C4' or O4') are independently or in combination absent from the nucleotide. In some embodiments, acyclic nucleotide is

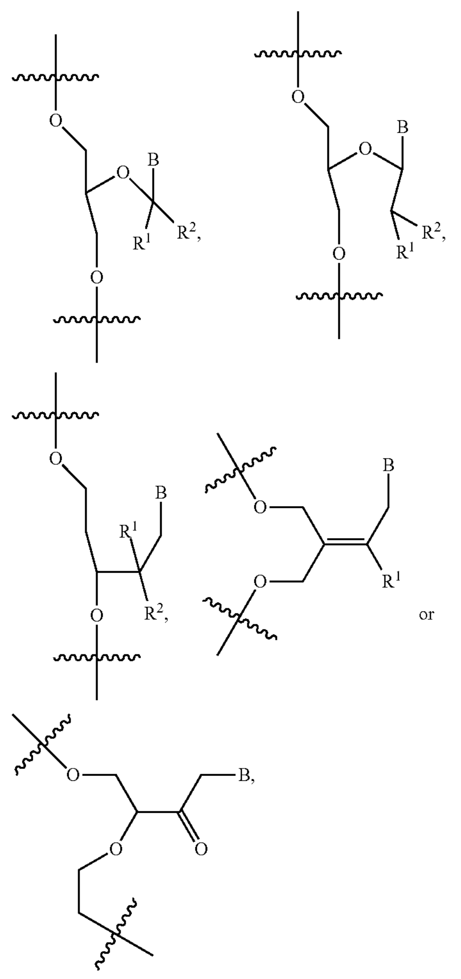

or wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The term "UNA" refers to unlocked acyclic nucleic acid, wherein any of the bonds of the sugar has been removed, forming an unlocked "sugar" residue. In one example, UNA also encompasses monomers with bonds between C1'-C4' being removed (i.e. the covalent carbon-oxygen-carbon bond between the C1' and C4' carbons). In another example, the C2'-C3' bond (i.e. the covalent carbon-carbon bond between the C2' and C3' carbons) of the sugar is removed (see Mikhailov et. al., Tetrahedron Letters, 26 (17): 2059 (1985); and Fluiter et al., Mol. Biosyst., 10: 1039 (2009), which are hereby incorporated by reference in their entirety). The acyclic derivative provides greater backbone flexibility without affecting the Watson-Crick pairings. The acyclic nucleotide can be linked via 2'-5' or 3'-5' linkage.

The term 'GNA' refers to glycol nucleic acid which is a polymer similar to DNA or RNA but differing in the composition of its "backbone" in that is composed of repeating glycerol units linked by phosphodiester bonds:

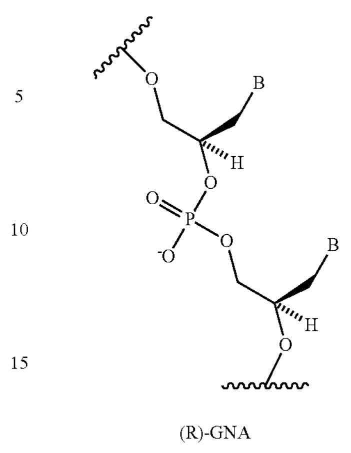

(R)-GNA

The thermally destabilizing modification of the duplex can be mismatches (i.e., noncomplementary base pairs) between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA molecule contains at least one nucleobase in the mismatch pairing that is a 2'-deoxy nucleobase; e.g., the 2'-deoxy nucleobase is in the sense strand.

In some embodiments, the thermally destabilizing modification of the duplex in the seed region of the antisense strand includes nucleotides with impaired W—C H-bonding to complementary base on the target mRNA, such as:

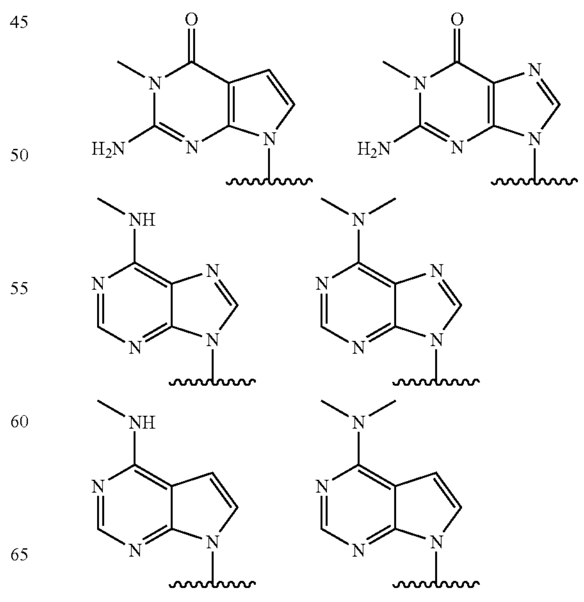

-continued

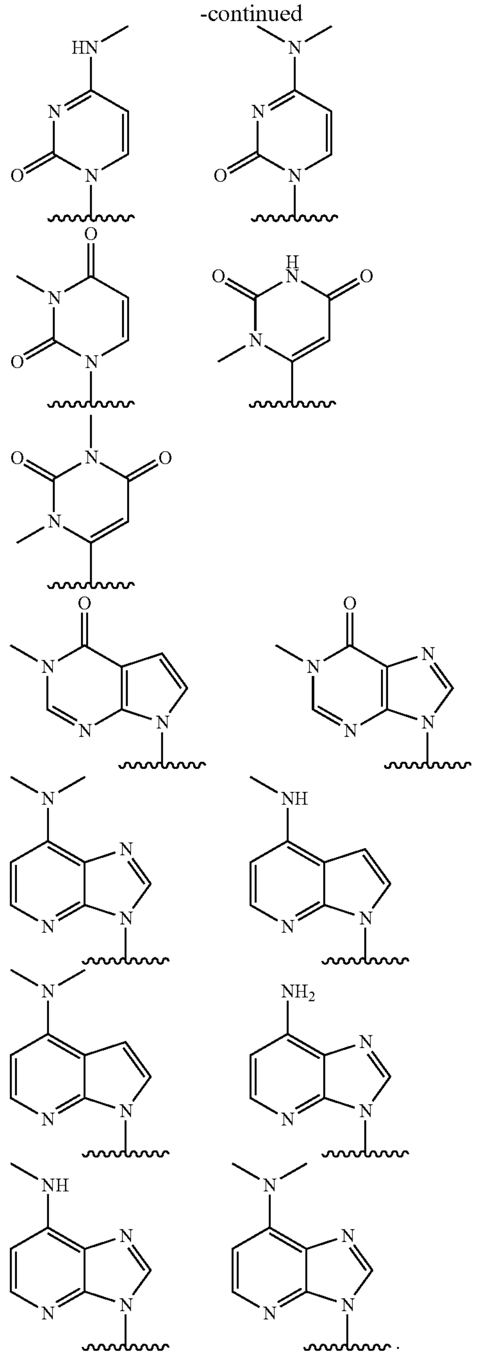

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

In some embodiments, the thermally destabilizing modification of the duplex includes nucleotides with non-canonical bases such as, but not limited to, nucleobase modifications with impaired or completely abolished capability to form hydrogen bonds with bases in the opposite strand.

These nucleobase modifications have been evaluated for destabilization of the central region of the dsRNA duplex as described in WO 2010/0011895, which is herein incorporated by reference in its entirety. Exemplary nucleobase modifications are:

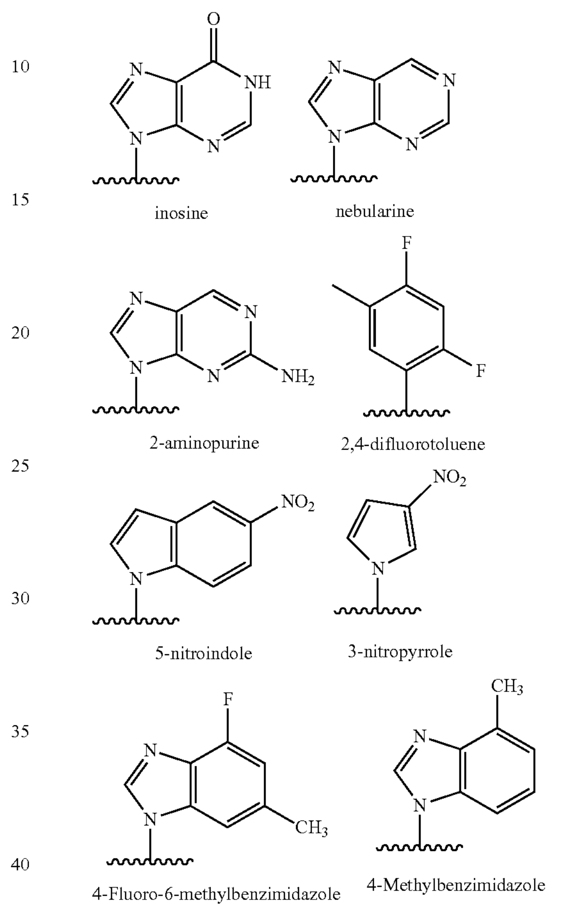

inosine nebularine 2-aminopurine 2,4-difluorotoluene 5-nitroindole 3-nitropyrrole 4-Fluoro-6-methylbenzimidazole 4-Methylbenzimidazole In some embodiments, the thermally destabilizing modification of the duplex in the seed region of the antisense strand includes one or more α-nucleotide complementary to the base on the target mRNA, such as:

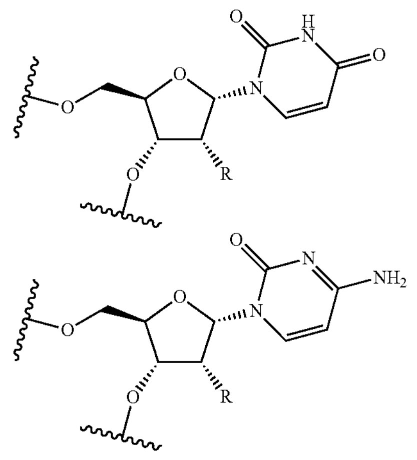

-continued

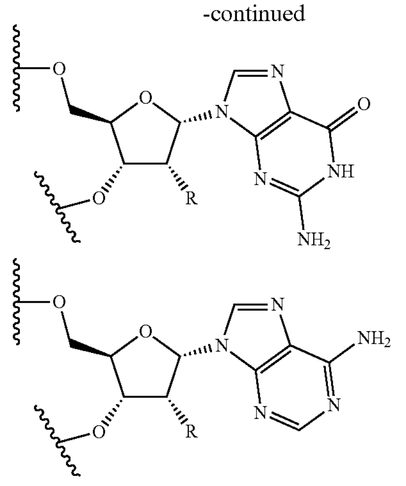

wherein R is H, OH, $OCH_3$, F, $NH_2$, NHMe, $NMe_2$ or O-alkyl.

Exemplary phosphate modifications known to decrease the thermal stability of dsRNA duplexes compared to natural phosphodiester linkages are:

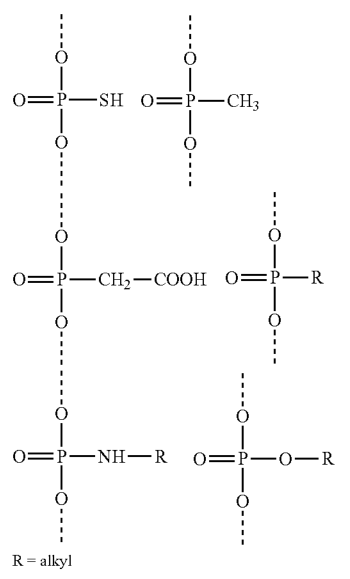

The alkyl for the R group can be a $C_1$-$C_6$alkyl. Specific alkyls for the R group include, but are not limited to methyl, ethyl, propyl, isopropyl, butyl, pentyl and hexyl.

As the skilled artisan will recognize, in view of the functional role of nucleobases is defining specificity of an RNAi agent of the disclosure, while nucleobase modifications can be performed in the various manners as described herein, e.g., to introduce destabilizing modifications into an RNAi agent of the disclosure, e.g., for purpose of enhancing on-target effect relative to off-target effect, the range of modifications available and, in general, present upon RNAi agents of the disclosure tends to be much greater for non-nucleobase modifications, e.g., modifications to sugar groups or phosphate backbones of polyribonucleotides. Such modifications are described in greater detail in other sections of the instant disclosure and are expressly contemplated for RNAi agents of the disclosure, either possessing native nucleobases or modified nucleobases as described above or elsewhere herein.

In addition to the antisense strand comprising a thermally destabilizing modification, the dsRNA can also comprise one or more stabilizing modifications. For example, the dsRNA can comprise at least two (e.g., two, three, four, five, six, seven, eight, nine, ten or more) stabilizing modifications. Without limitations, the stabilizing modifications all can be present in one strand. In some embodiments, both the sense and the antisense strands comprise at least two stabilizing modifications. The stabilizing modification can occur on any nucleotide of the sense strand or antisense strand. For instance, the stabilizing modification can occur on every nucleotide on the sense strand or antisense strand; each stabilizing modification can occur in an alternating pattern on the sense strand or antisense strand; or the sense strand or antisense strand comprises both stabilizing modification in an alternating pattern. The alternating pattern of the stabilizing modifications on the sense strand may be the same or different from the antisense strand, and the alternating pattern of the stabilizing modifications on the sense strand can have a shift relative to the alternating pattern of the stabilizing modifications on the antisense strand.

In some embodiments, the antisense strand comprises at least two (e.g., two, three, four, five, six, seven, eight, nine, ten or more) stabilizing modifications. Without limitations, a stabilizing modification in the antisense strand can be present at any positions. In some embodiments, the antisense comprises stabilizing modifications at positions 2, 6, 8, 9, 14, and 16 from the 5'-end. In some other embodiments, the antisense comprises stabilizing modifications at positions 2, 6, 14, and 16 from the 5'-end. In still some other embodiments, the antisense comprises stabilizing modifications at positions 2, 14, and 16 from the 5'-end.

In some embodiments, the antisense strand comprises at least one stabilizing modification adjacent to the destabilizing modification. For example, the stabilizing modification can be the nucleotide at the 5'-end or the 3'-end of the destabilizing modification, i.e., at position −1 or +1 from the position of the destabilizing modification. In some embodiments, the antisense strand comprises a stabilizing modification at each of the 5'-end and the 3'-end of the destabilizing modification, i.e., positions −1 and +1 from the position of the destabilizing modification.

In some embodiments, the antisense strand comprises at least two stabilizing modifications at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) stabilizing modifications. Without limitations, a stabilizing modification in the sense strand can be present at any positions. In some embodiments, the sense strand comprises stabilizing modifications at positions 7, 10, and 11 from the 5'-end. In some other embodiments, the sense strand comprises stabilizing modifications at positions 7, 9, 10, and 11 from the 5'-end. In some embodiments, the sense strand comprises stabilizing modifications at positions opposite or complimentary to positions 11, 12, and 15 of the antisense strand, counting from the 5'-end of the antisense strand. In some other embodiments, the sense strand comprises stabilizing modifications at positions opposite or complimentary to positions 11, 12, 13, and 15 of the antisense strand, counting from the 5'-end of the antisense strand. In some embodiments, the sense strand comprises a block of two, three, or four stabilizing modifications.

In some embodiments, the sense strand does not comprise a stabilizing modification in position opposite or complimentary to the thermally destabilizing modification of the duplex in the antisense strand.

Exemplary thermally stabilizing modifications include, but are not limited to, 2'-fluoro modifications. Other thermally stabilizing modifications include, but are not limited to, LNA.

In some embodiments, the dsRNA of the disclosure comprises at least four (e.g., four, five, six, seven, eight, nine, ten, or more) 2'-fluoro nucleotides. Without limitations, the 2'-fluoro nucleotides all can be present in one strand. In some embodiments, both the sense and the antisense strands comprise at least two 2'-fluoro nucleotides. The 2'-fluoro modification can occur on any nucleotide of the sense strand or antisense strand. For instance, the 2'-fluoro modification can occur on every nucleotide on the sense strand or antisense strand; each 2'-fluoro modification can occur in an alternating pattern on the sense strand or antisense strand; or the sense strand or antisense strand comprises both 2'-fluoro modifications in an alternating pattern. The alternating pattern of the 2'-fluoro modifications on the sense strand may be the same or different from the antisense strand, and the alternating pattern of the 2'-fluoro modifications on the sense strand can have a shift relative to the alternating pattern of the 2'-fluoro modifications on the antisense strand.

In some embodiments, the antisense strand comprises at least two (e.g., two, three, four, five, six, seven, eight, nine, ten, or more) 2'-fluoro nucleotides. Without limitations, a 2'-fluoro modification in the antisense strand can be present at any positions. In some embodiments, the antisense comprises 2'-fluoro nucleotides at positions 2, 6, 8, 9, 14, and 16 from the 5'-end. In some other embodiments, the antisense comprises 2'-fluoro nucleotides at positions 2, 6, 14, and 16 from the 5'-end. In still some other embodiments, the antisense comprises 2'-fluoro nucleotides at positions 2, 14, and 16 from the 5'-end.

In some embodiments, the antisense strand comprises at least one 2'-fluoro nucleotide adjacent to the destabilizing modification. For example, the 2'-fluoro nucleotide can be the nucleotide at the 5'-end or the 3'-end of the destabilizing modification, i.e., at position −1 or +1 from the position of the destabilizing modification. In some embodiments, the antisense strand comprises a 2'-fluoro nucleotide at each of the 5'-end and the 3'-end of the destabilizing modification, i.e., positions −1 and +1 from the position of the destabilizing modification.

In some embodiments, the antisense strand comprises at least two 2'-fluoro nucleotides at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) 2'-fluoro nucleotides. Without limitations, a 2'-fluoro modification in the sense strand can be present at any positions. In some embodiments, the antisense comprises 2'-fluoro nucleotides at positions 7, 10, and 11 from the 5'-end. In some other embodiments, the sense strand comprises 2'-fluoro nucleotides at positions 7, 9, 10, and 11 from the 5'-end. In some embodiments, the sense strand comprises 2'-fluoro nucleotides at positions opposite or complimentary to positions 11, 12, and 15 of the antisense strand, counting from the 5'-end of the antisense strand. In some other embodiments, the sense strand comprises 2'-fluoro nucleotides at positions opposite or complimentary to positions 11, 12, 13, and 15 of the antisense strand, counting from the 5'-end of the antisense strand. In some embodiments, the sense strand comprises a block of two, three or four 2'-fluoro nucleotides.

In some embodiments, the sense strand does not comprise a 2'-fluoro nucleotide in position opposite or complimentary to the thermally destabilizing modification of the duplex in the antisense strand.

In some embodiments, the dsRNA molecule of the disclosure comprises a 21 nucleotides (nt) sense strand and a 23 nucleotides (nt) antisense, wherein the antisense strand contains at least one thermally destabilizing nucleotide, where the at least one thermally destabilizing nucleotide occurs in the seed region of the antisense strand (i.e., at position 2-9 of the 5'-end of the antisense strand), wherein one end of the dsRNA is blunt, while the other end is comprises a 2 nt overhang, and wherein the dsRNA optionally further has at least one (e.g., one, two, three, four, five, six or all seven) of the following characteristics: (i) the antisense comprises 2, 3, 4, 5 or 6 2'-fluoro modifications; (ii) the antisense comprises 1, 2, 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4 or 5 phosphorothioate internucleotide linkages; (vi) the dsRNA comprises at least four 2'-fluoro modifications; and (vii) the dsRNA comprises a blunt end at 5'-end of the antisense strand. Preferably, the 2 nt overhang is at the 3'-end of the antisense.

In some embodiments, the dsRNA molecule of the disclosure comprising a sense and antisense strands, wherein: the sense strand is 25-30 nucleotide residues in length, wherein starting from the 5' terminal nucleotide (position 1), positions 1 to 23 of said sense strand comprise at least 8 ribonucleotides; antisense strand is 36-66 nucleotide residues in length and, starting from the 3' terminal nucleotide, at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when said double stranded nucleic acid is introduced into a mammalian cell; and wherein the antisense strand contains at least one thermally destabilizing nucleotide, where at least one thermally destabilizing nucleotide is in the seed region of the antisense strand (i.e. at position 2-9 of the 5'-end of the antisense strand). For example, the thermally destabilizing nucleotide occurs between positions opposite or complimentary to positions 14-17 of the 5'-end of the sense strand, and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA comprises a duplex region of 12-30 nucleotide pairs in length.

In some embodiments, the dsRNA molecule of the disclosure comprises a sense and antisense strands, wherein said dsRNA molecule comprises a sense strand having a length which is at least 25 and at most 29 nucleotides and an antisense strand having a length which is at most 30 nucleotides with the sense strand comprises a modified nucleotide that is susceptible to enzymatic degradation at position 11 from the 5'end, wherein the 3' end of said sense strand and the 5' end of said antisense strand form a blunt end and said antisense strand is 1-4 nucleotides longer at its 3' end than the sense strand, wherein the duplex region which is at least 25 nucleotides in length, and said antisense strand is sufficiently complementary to a target mRNA along at least 19 nt of said antisense strand length to reduce target gene expression when said dsRNA molecule is introduced into a mammalian cell, and wherein dicer cleavage of said dsRNA preferentially results in an siRNA comprising said 3' end of said antisense strand, thereby reducing expression of the target gene in the mammal, wherein the antisense strand contains at least one thermally destabilizing nucleotide, where the at least one thermally destabilizing nucleotide is in the seed region of the antisense strand (i.e. at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA has a duplex region of 12-29 nucleotide pairs in length.

In some embodiments, every nucleotide in the sense strand and antisense strand of the dsRNA molecule may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking 0 of a phosphate moiety. In some cases, the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of an RNA. E.g., a phosphorothioate modification at a non-linking 0 position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, HNA, CeNA, 2'-methoxyethyl, 2'-O-methyl, 2'-O-allyl, 2'-C-allyl, 2'-deoxy, or 2'-fluoro. The strands can contain more than one modification. In some embodiments, each residue of the sense strand and antisense strand is independently modified with 2'-O-methyl or 2'-fluoro. It is to be understood that these modifications are in addition to the at least one thermally destabilizing modification of the duplex present in the antisense strand.

At least two different modifications are typically present on the sense strand and antisense strand. Those two modifications may be the 2'-deoxy, 2'-O-methyl or 2'-fluoro modifications, acyclic nucleotides or others. In some embodiments, the sense strand and antisense strand each comprises two differently modified nucleotides selected from 2'-O-methyl or 2'-deoxy. In some embodiments, each residue of the sense strand and antisense strand is independently modified with 2'-O-methyl nucleotide, 2'-deoxy nucleotide, 2'-deoxy-2'-fluoro nucleotide, 2'-O—N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, or 2'-ara-F nucleotide. Again, it is to be understood that these modifications are in addition to the at least one thermally destabilizing modification of the duplex present in the antisense strand.

In some embodiments, the dsRNA molecule of the disclosure comprises modifications of an alternating pattern, particular in the B1, B2, B3, B1', B2', B3', B4' regions. The term "alternating motif" or "alternative pattern" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc. The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNA molecule of the disclosure comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5' of the strand within the duplex region. As another example, the alternating motif in the sense strand may start with "AABBAABB" from 5'-3' of the strand and the alternating motif in the antisense strand may start with "BBAABBAA" from 3'-5' of the strand within the duplex region, so that there is a complete or partial shift of the modification patterns between the sense strand and the antisense strand.

The dsRNA molecule of the disclosure may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA molecule comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. Preferably, these terminal three nucleotides may be at the 3'-end of the antisense strand.

In some embodiments, the sense strand of the dsRNA molecule comprises 1-10 blocks of two to ten phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of three phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of four phosphorothioate or methylphosphonate internucleotide linkages separated by 1, 2, 3, 4, 5, 6, 7, 8, 9, 10, 11, 12, 13, or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of five phosphorothioate or methylphosphonate internucleotide linkages separated by 1, 2, 3, 4, 5, 6, 7, 8, 9, 10, 11, or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of six phosphorothioate or methylphosphonate internucleotide linkages separated by 1, 2, 3, 4, 5, 6, 7, 8, 9, or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of seven phosphorothioate or methylphosphonate internucleotide linkages separated by 1, 2, 3, 4, 5, 6, 7, or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of eight phosphorothioate or methylphosphonate internucleotide linkages separated by 1, 2, 3, 4, 5, or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of nine phosphorothioate or methylphosphonate internucleotide linkages separated by 1, 2, 3, or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the dsRNA molecule of the disclosure further comprises one or more phosphorothioate or methylphosphonate internucleotide linkage modification within 1-10 of the termini position(s) of the sense or antisense strand. For example, at least 2, 3, 4, 5, 6, 7, 8, 9, or 10 nucleotides may be linked through phosphorothioate or methylphosphonate internucleotide linkage at one end or both ends of the sense or antisense strand.

In some embodiments, the dsRNA molecule of the disclosure further comprises one or more phosphorothioate or methylphosphonate internucleotide linkage modification within 1-10 of the internal region of the duplex of each of the sense or antisense strand. For example, at least 2, 3, 4, 5, 6, 7, 8, 9, or 10 nucleotides may be linked through phosphorothioate methylphosphonate internucleotide linkage at position 8-16 of the duplex region counting from the 5'-end of the sense strand; the dsRNA molecule can optionally further comprise one or more phosphorothioate or methylphosphonate internucleotide linkage modification within 1-10 of the termini position(s).

In some embodiments, the dsRNA molecule of the disclosure further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In some embodiments, the dsRNA molecule of the disclosure further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 and 2 and two phosphorothioate or methylphosphonate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 (counting from the 5'-end) of the sense strand, and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, compound of the disclosure comprises a pattern of backbone chiral centers. In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration. In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, compound of the disclosure comprises a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, compound of the disclosure comprises a 5'-block is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, compound of the disclosure comprises a type of nucleoside in a region or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp.

In some embodiments, the antisense strand comprises phosphorothioate internucleotide linkages between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the antisense comprises 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the sense strand is conjugated with a ligand; (iii) the sense strand comprises 2, 3, 4 or 5 2'-fluoro modifications; (iv) the sense strand comprises 1, 2, 3, 4 or 5 phosphorothioate internucleotide linkages; (v) the dsRNA comprises at least four 2'-fluoro modifications; (vi) the dsRNA comprises a duplex region of 12-40 nucleotide pairs in length; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the antisense comprises 1, 2, 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5 or 6 2'-fluoro modifications; (ii) the sense strand is conjugated with a ligand; (iii) the sense strand comprises 2, 3, 4 or 5 2'-fluoro modifications; (iv) the sense strand comprises 3, 4 or 5 phosphorothioate internucleotide linkages; (v) the dsRNA comprises at least four 2'-fluoro modifications; (vi) the dsRNA comprises a duplex region of 12-40 nucleotide pairs in length; and (vii) the dsRNA has a blunt end at 5'-end of the antisense strand.

In some embodiments, the dsRNA molecule of the disclosure comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings. In some embodiments, the dsRNA molecule of the disclosure comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

It was found that introducing 4'-modified or 5'-modified nucleotide to the 3'-end of a phosphodiester (PO), phosphorothioate (PS), or phosphorodithioate (PS2) linkage of a dinucleotide at any position of single stranded or double stranded oligonucleotide can exert steric effect to the internucleotide linkage and, hence, protecting or stabilizing it against nucleases.

In some embodiments, 5'-modified nucleoside is introduced at the 3'-end of a dinucleotide at any position of single stranded or double stranded siRNA. For instance, a 5'-alkylated nucleoside may be introduced at the 3'-end of a dinucleotide at any position of single stranded or double stranded siRNA. The alkyl group at the 5' position of the ribose sugar can be racemic or chirally pure R or S isomer. An exemplary 5'-alkylated nucleoside is 5'-methyl nucleoside. The 5'-methyl can be either racemic or chirally pure R or S isomer.

In some embodiments, 4'-modified nucleoside is introduced at the 3'-end of a dinucleotide at any position of single stranded or double stranded siRNA. For instance, a 4'-alkylated nucleoside may be introduced at the 3'-end of a dinucleotide at any position of single stranded or double stranded siRNA. The alkyl group at the 4' position of the ribose sugar can be racemic or chirally pure R or S isomer. An exemplary 4'-alkylated nucleoside is 4'-methyl nucleoside. The 4'-methyl can be either racemic or chirally pure R or S isomer. Alternatively, a 4'-O-alkylated nucleoside may be introduced at the 3'-end of a dinucleotide at any position of single stranded or double stranded siRNA. The 4'-O-alkyl of the ribose sugar can be racemic or chirally pure R or S isomer. An exemplary 4'-O-alkylated nucleoside is 4'-O-methyl nucleoside. The 4'-O-methyl can be either racemic or chirally pure R or S isomer.

In some embodiments, 5'-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleoside is 5'-methyl nucleoside. The 5'-methyl can be either racemic or chirally pure R or S isomer.

In some embodiments, 4'-alkylated nucleoside is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleoside is 4'-methyl nucleoside. The 4'-methyl can be either racemic or chirally pure R or S isomer.

In some embodiments, 4'-O-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleoside is 4'-O-methyl nucleoside. The 4'-O-methyl can be either racemic or chirally pure R or S isomer.

In some embodiments, the dsRNA molecule of the disclosure can comprise 2'-5' linkages (with 2'-H, 2'-OH and 2'-OMe and with P═O or P═S). For example, the 2'-5' linkages modifications can be used to promote nuclease resistance or to inhibit binding of the sense to the antisense strand, or can be used at the 5' end of the sense strand to avoid sense strand activation by RISC.

In another embodiment, the dsRNA molecule of the disclosure can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5' end of the sense strand to avoid sense strand activation by RISC.

Various publications describe multimeric siRNA which can all be used with the dsRNA of the disclosure. Such publications include WO2007/091269, U.S. Pat. No. 7,858,769, WO2010/141511, WO2007/117686, WO2009/014887, and WO2011/031520 which are hereby incorporated by their entirely.

As described in more detail below, the RNAi agent that contains conjugations of one or more carbohydrate moieties to an RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the disclosure is an agent selected from the group of agents listed in any one of Tables 2, 3, 5, 6, 8, 9, 11, 12, 14, 15, 17, 18, 20, 21, 24, 25, 27-30, 32 and 33. These agents may further comprise a ligand.

IV. iRNAs Conjugated to Ligands

Another modification of the RNA of an iRNA of the invention involves chemically linking to the iRNA one or more ligands, moieties or conjugates that enhance the activity, cellular distribution or cellular uptake of the iRNA, e.g., into a cell. Such moieties include but are not limited to lipid moieties such as a cholesterol moiety (Letsinger et al., *Proc. Natl. Acid. Sci. USA,* 1989, 86: 6553-6556), cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethylammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylaminocarbonyloxycholesterol moiety (Crooke et al., *J. Pharmacol. Exp. Ther.,* 1996, 277:923-937).

In certain embodiments, a ligand alters the distribution, targeting or lifetime of an iRNA agent into which it is incorporated. In some embodiments, a ligand provides an enhanced affinity for a selected target, e.g., molecule, cell or cell type, compartment, e.g., a cellular or organ compartment, tissue, organ or region of the body, as, e.g., compared to a species absent such a ligand. Typical ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an α helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of P38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule can typically bind a serum protein, such as human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid-based ligand can be used to modulate, e.g., control (e.g., inhibit) the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid-based ligand binds HSA. For example, the ligand can bind HSA with a sufficient affinity such that distribution of the conjugate to a non-kidney tissue is enhanced. However, the affinity is typically not so strong that the HSA-ligand binding cannot be reversed.

In certain embodiments, the lipid-based ligand binds HSA weakly or not at all, such that distribution of the conjugate to the kidney is enhanced. Other moieties that target to kidney cells can also be used in place of or in addition to the lipid-based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low density lipoprotein (LDL).

B. Cell Permeation Agents

In another aspect, the ligand is a cell-permeation agent, such as a helical cell-permeation agent. In certain embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is typically an α-helical agent and can have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 11). An RFGF analogue (e.g., amino acid sequence AALLPVLLAAP (SEQ ID NO: 12)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 13)) and the *Drosophila* Antennapedia protein (RQIKIWFQNRRMKWKK (SEQ ID NO: 14)) have been found to be capable of functioning as delivery peptides. A peptide or peptidomimetic can be encoded by a random sequence of DNA, such as a peptide identified from a phage-display library, or one-bead-one-compound (OB OC) combinatorial library (Lam et al., *Nature,* 354:82-84, 1991). Typically, the peptide or peptidomimetic tethered to a dsRNA agent via an incorporated monomer unit is a cell targeting peptide such as an arginine-glycine-aspartic acid (RGD)-peptide, or RGD mimic A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidomimetics may include D-amino acids, as well as synthetic RGD mimics. In addition to RGD, one can use other moieties that target the integrin ligand. Preferred conjugates of this ligand target PECAM-1 or VEGF.

An RGD peptide moiety can be used to target a particular cell type, e.g., a tumor cell, such as an endothelial tumor cell or a breast cancer tumor cell (Zitzmann et al., *Cancer Res.,* 62:5139-43, 2002). An RGD peptide can facilitate targeting of an dsRNA agent to tumors of a variety of other tissues, including the lung, kidney, spleen, or liver (Aoki et al., *Cancer Gene Therapy* 8:783-787, 2001). Typically, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha v\beta_3$ (Haubner et al., *Jour. Nucl. Med.,* 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gP41 and the NLS of SV40 large T antigen (Simeoni et al., *Nucl. Acids Res.* 31:2717-2724, 2003).

C. Carbohydrate Conjugates

In some embodiments of the compositions and methods of the invention, an iRNA further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and tri-saccharides include sugars having two or three monosaccharide units (e.g., C5, C6, C7, or C8).

In certain embodiments, a carbohydrate conjugate comprises a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, the GalNAc conjugate is

Formula II

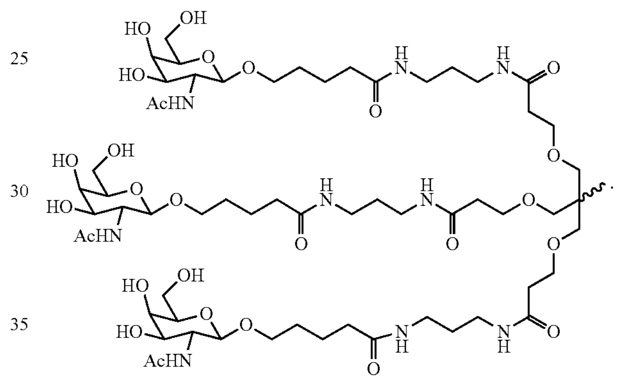

In some embodiments, the RNAi agent is attached to the carbohydrate conjugate via a linker as shown in the following schematic, wherein X is O or S

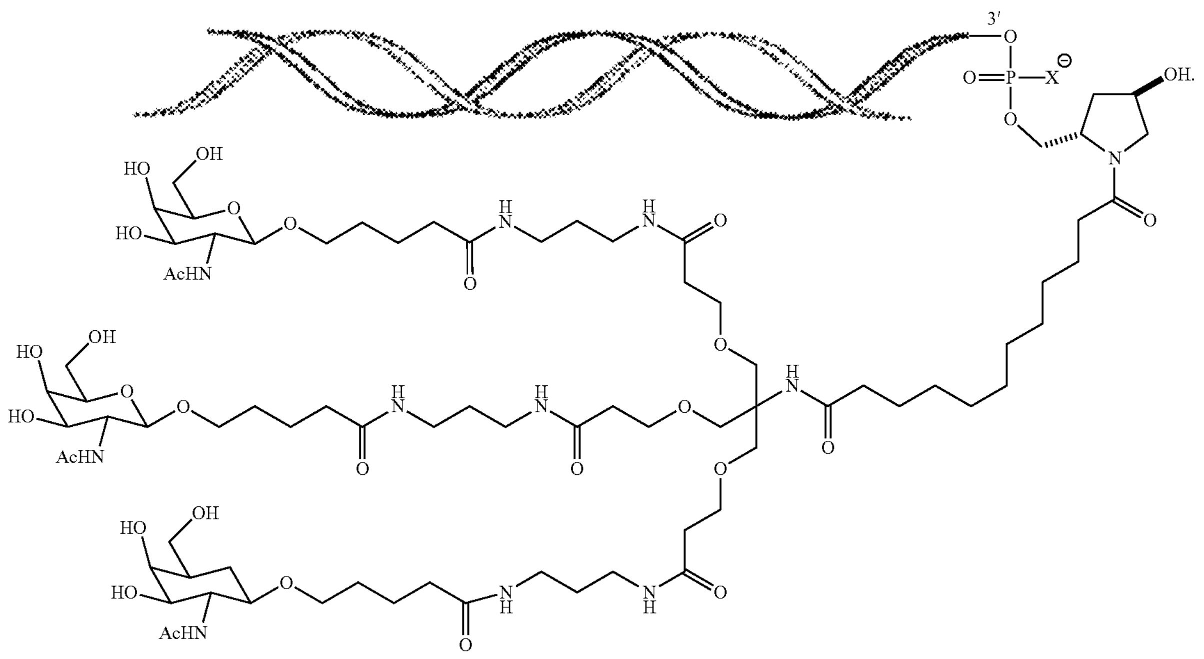

In some embodiments, the RNAi agent is conjugated to L96 as defined in Table 1 and shown below:
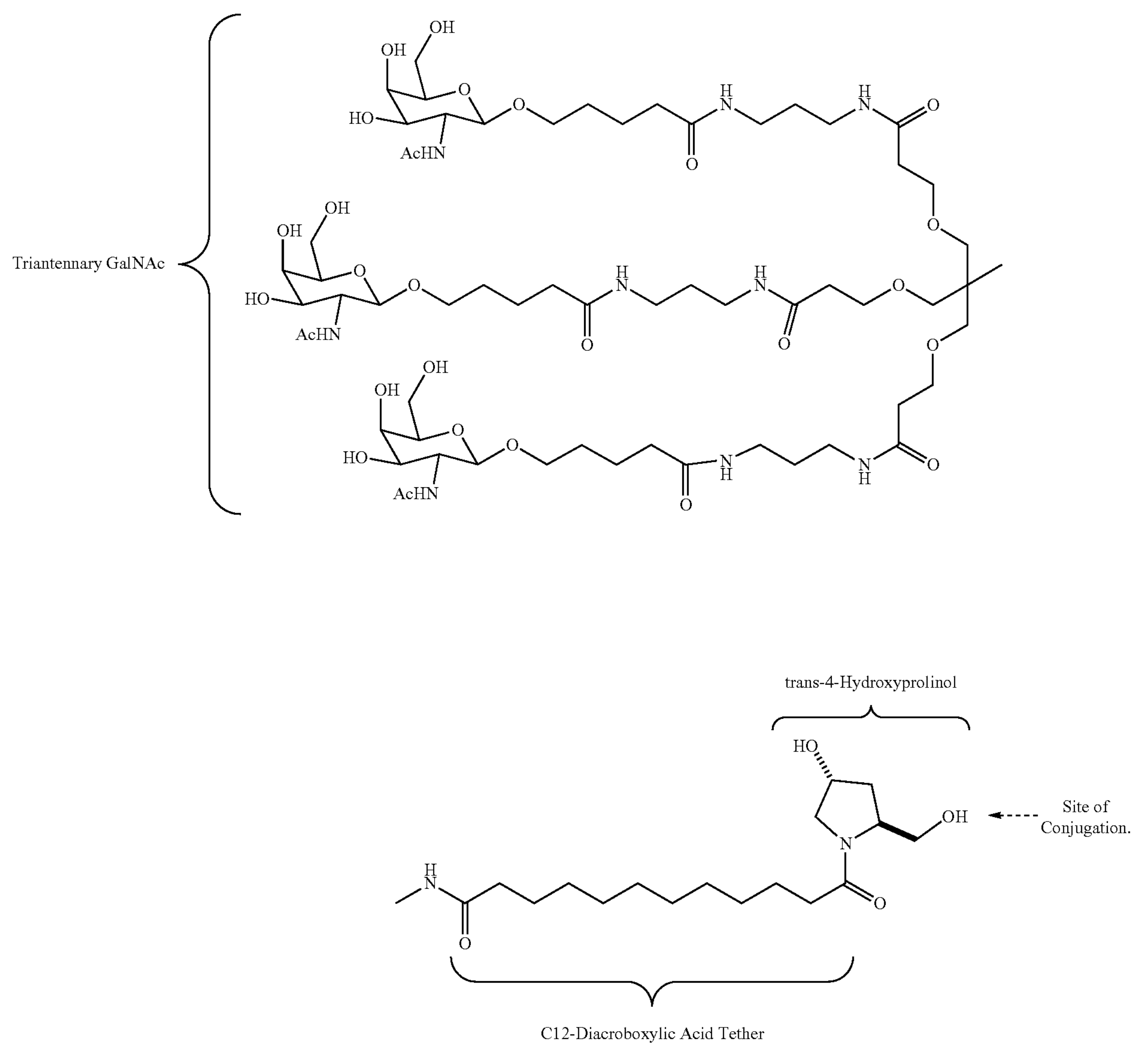
In certain embodiments, a carbohydrate conjugate for use in the compositions and methods of the invention is selected from the group consisting of:

Formula II
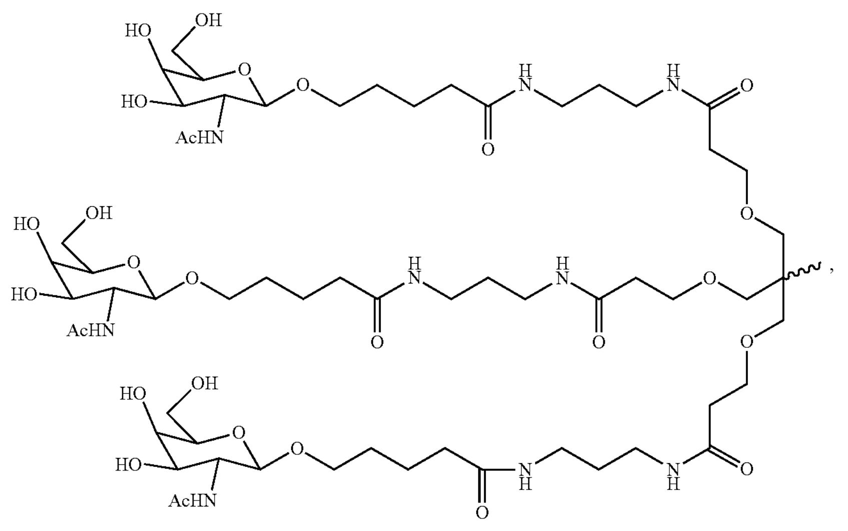
,
Formula III
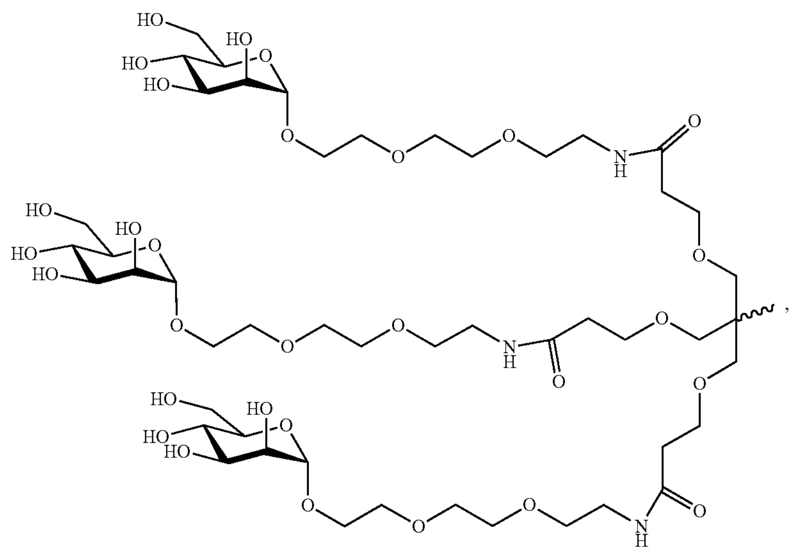
,
Formula IV
Formula V
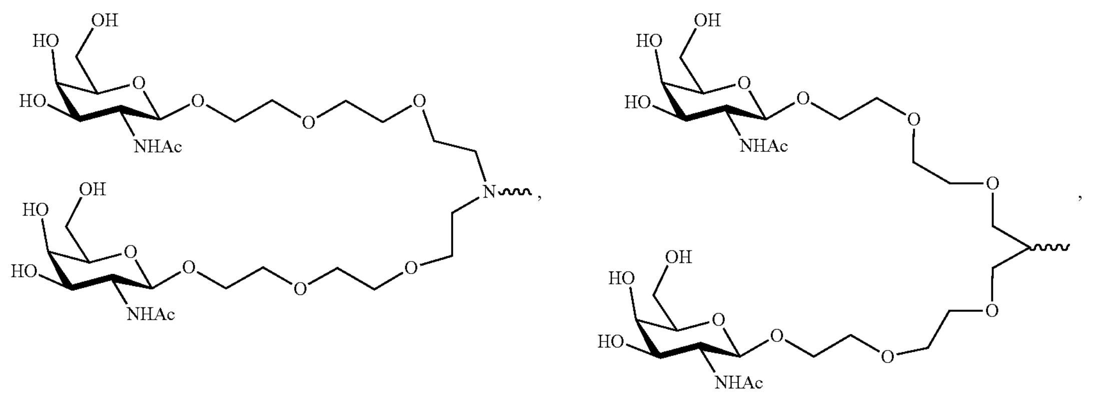
, , -continued
Formula VI
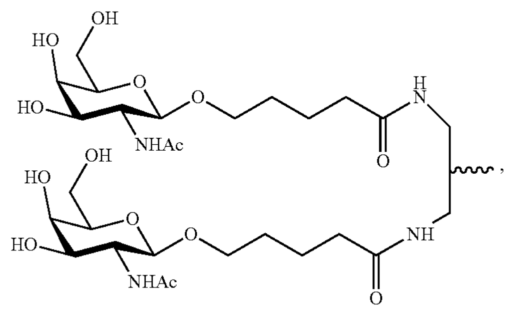
Formula VII
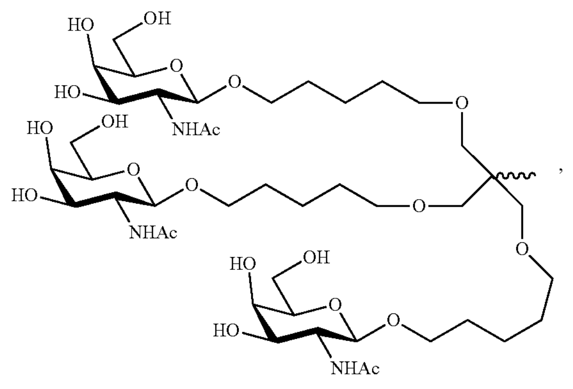
Formula VIII
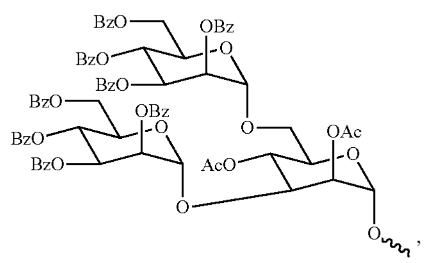
Formula IX
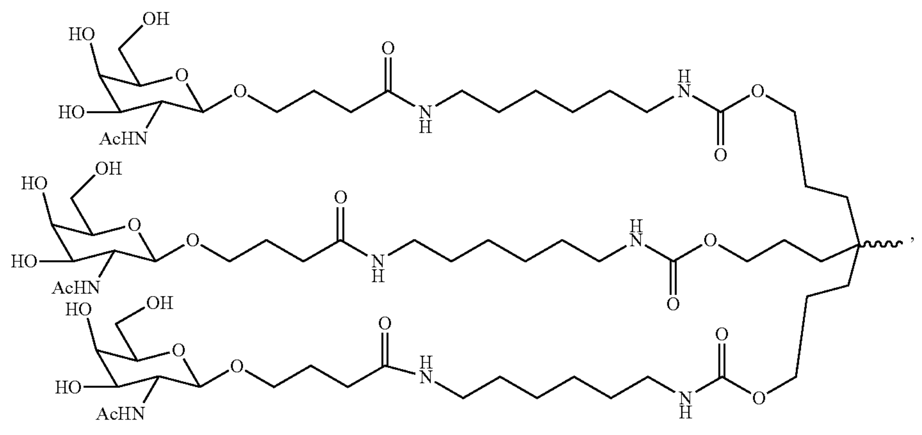
Formula X
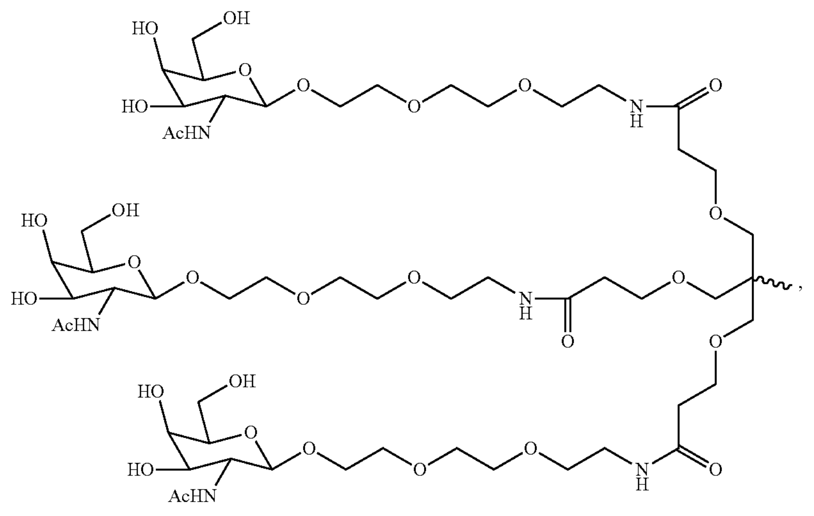

-continued
Formula XI
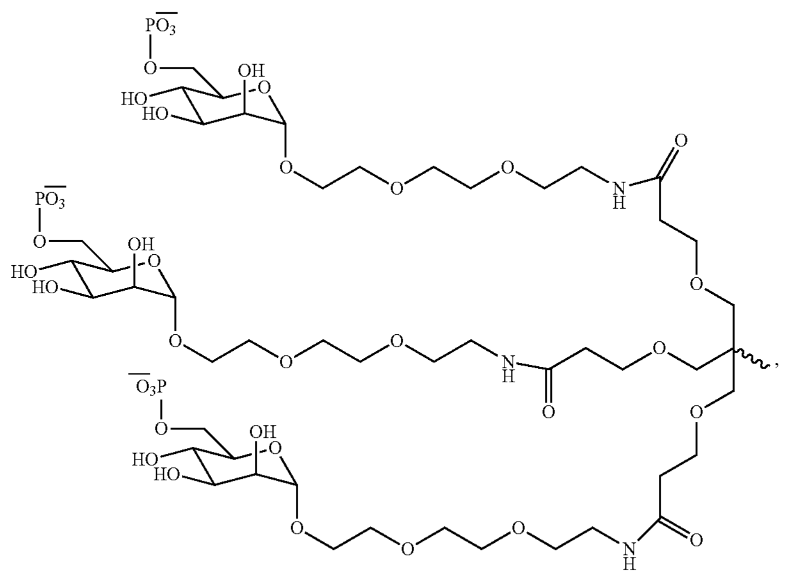
Formula XII
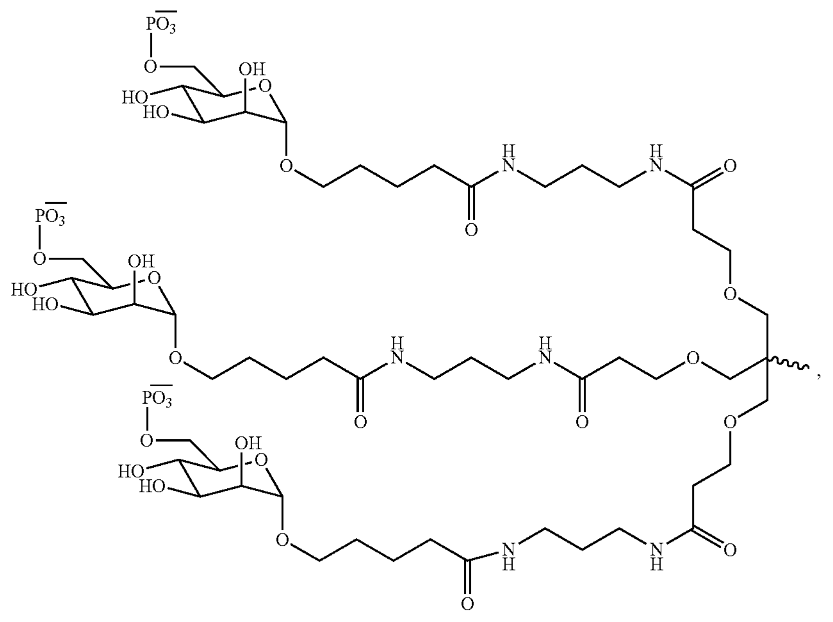
Formula XIII
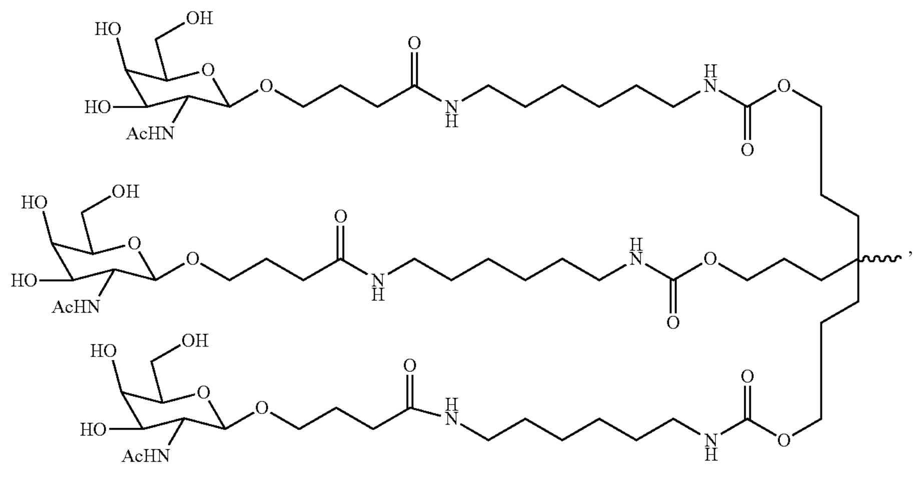

-continued
Formula XIV
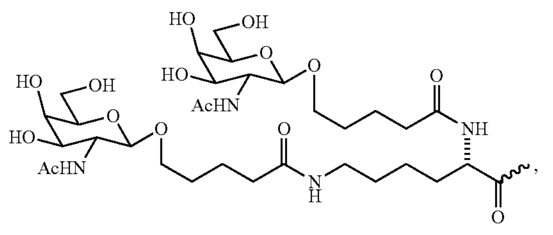
Formula XV
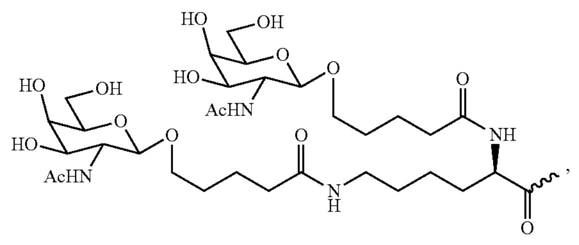
Formula XVI
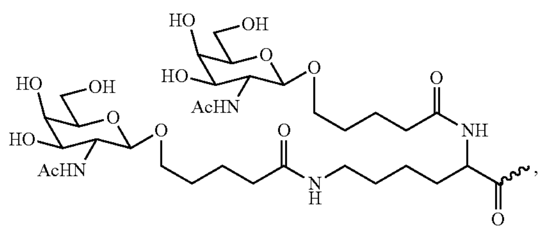
Formula XVII
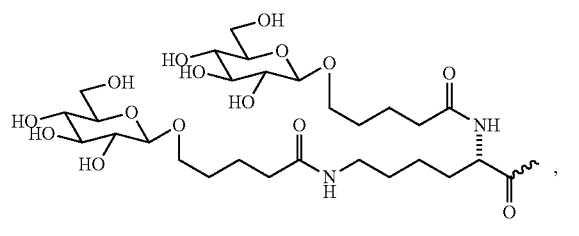
Formula XVIII
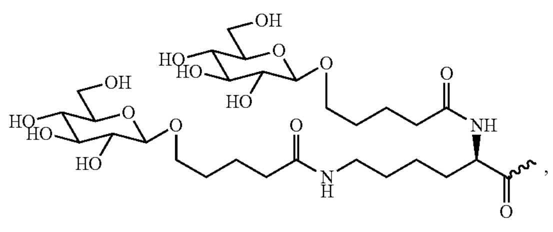
Formula XIX
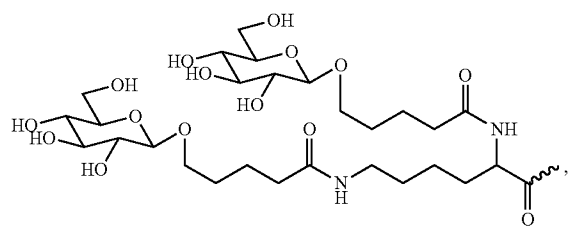
Formula XX
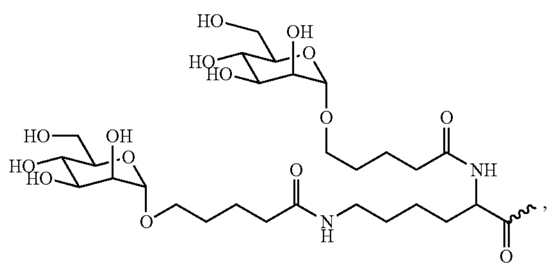
Formula XXI
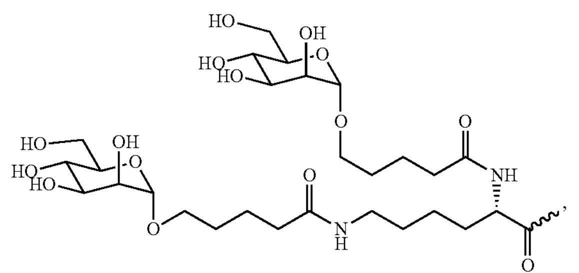
Formula XXII
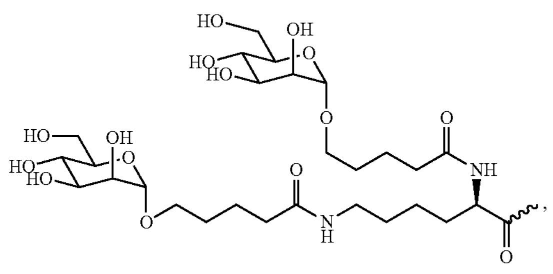
Formula XXIII
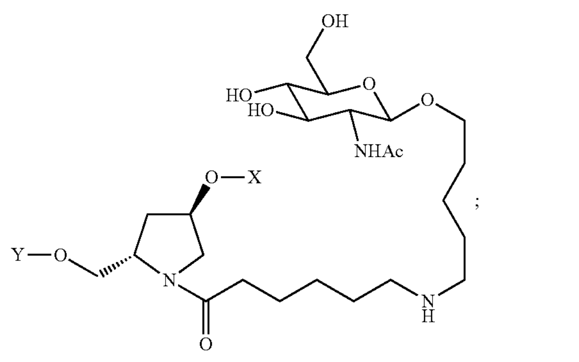

-continued
(Formula XXIV)
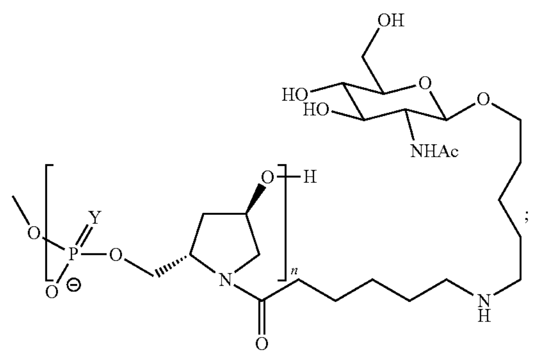
wherein Y is O or S and n is 3-6
(Formula XXV)
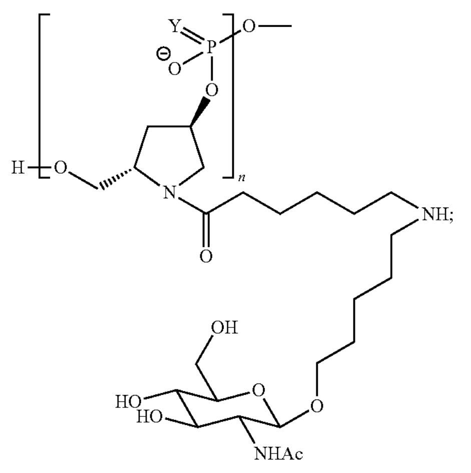
wherein Y is O or S and n is 3-6
Formula XXVI
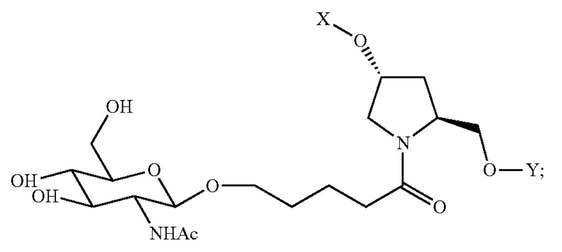
(Formula XXVII)
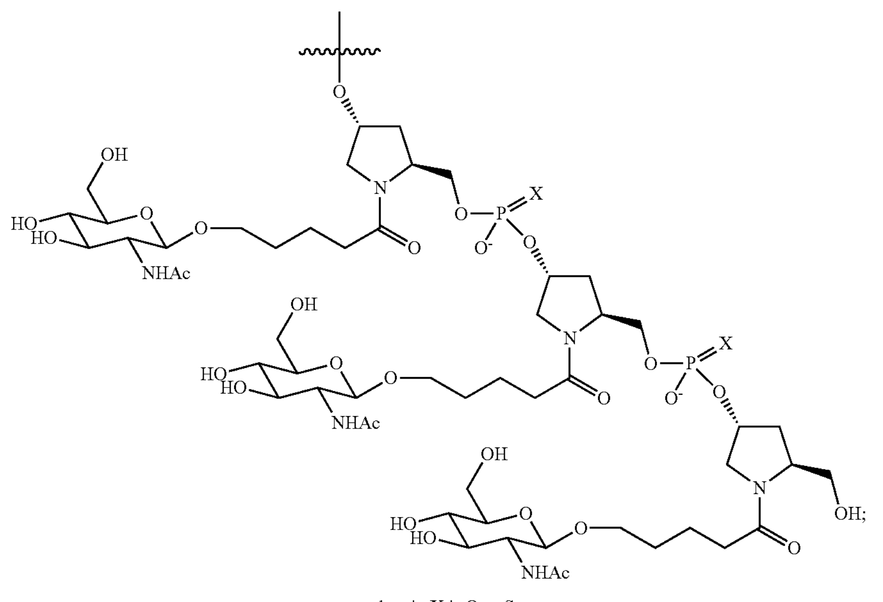
wherein X is O or S -continued
Formula XXVII
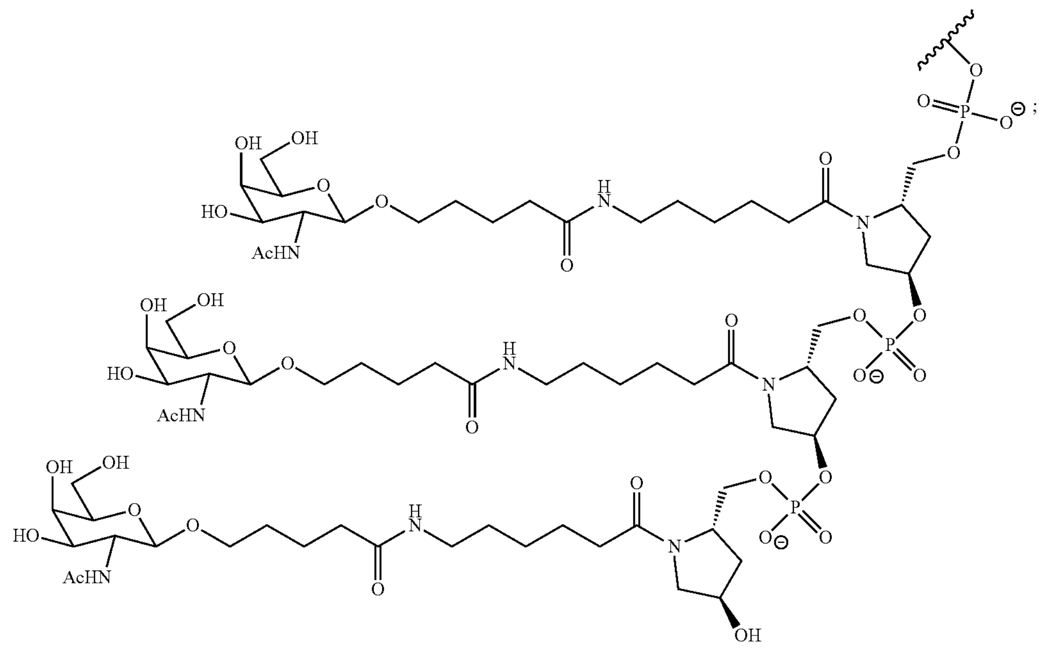
Formula XXIX
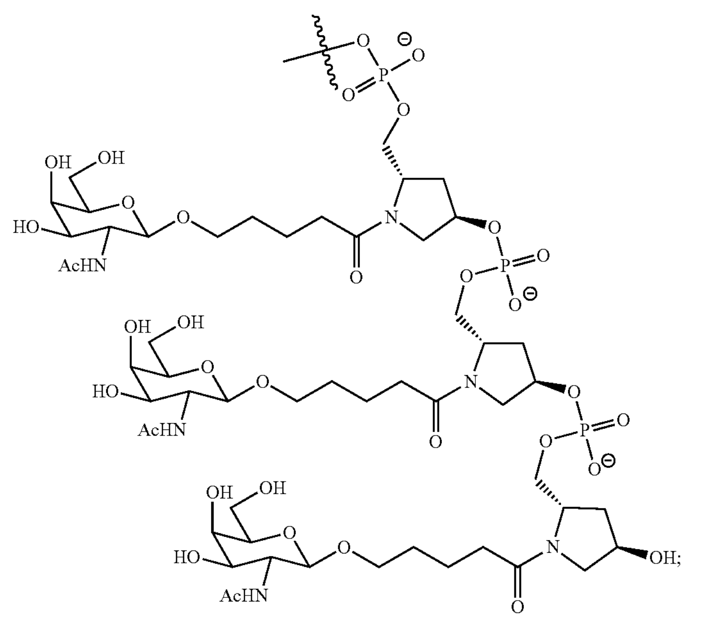

-continued
Formula XXX
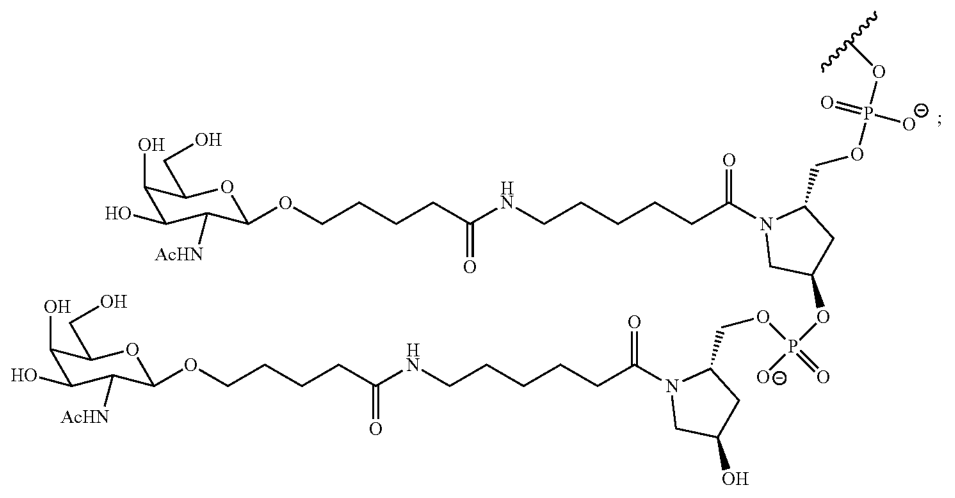
Formula XXXI
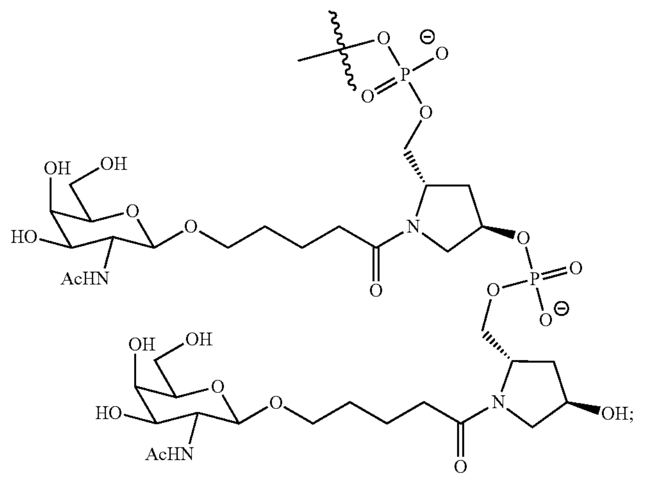
Formula XXXII
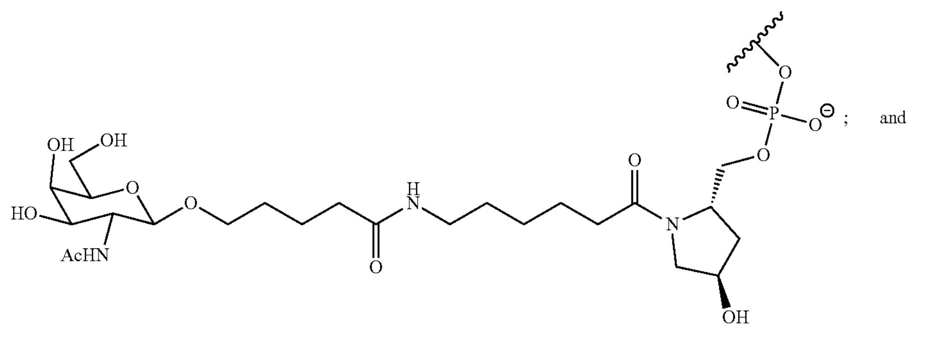
and
Formula XXXIII
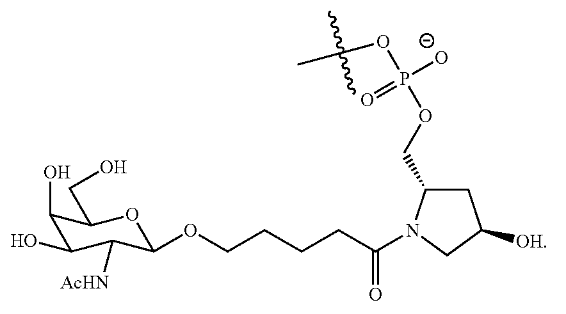

-continued

Formula XXXIV

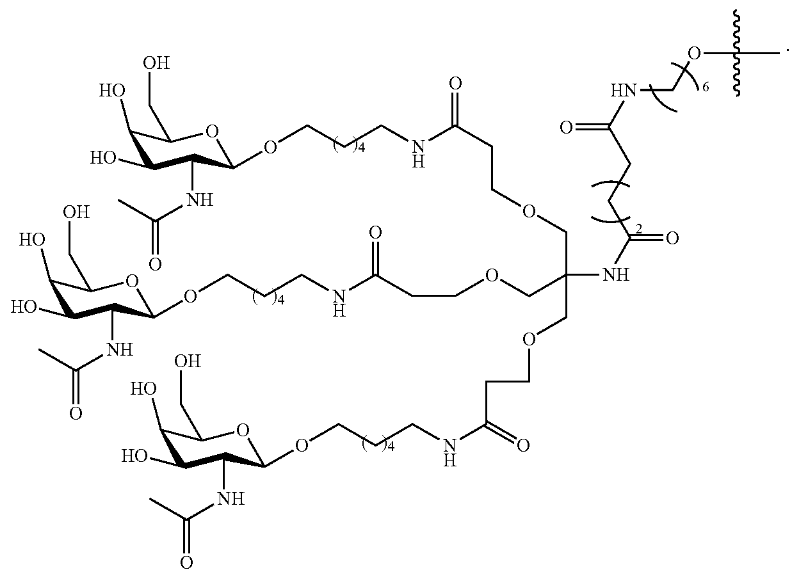

In certain embodiments, a carbohydrate conjugate for use in the compositions and methods of the invention is a monosaccharide. In certain embodiments, the monosaccharide is an N-acetylgalactosamine, such as Formula II

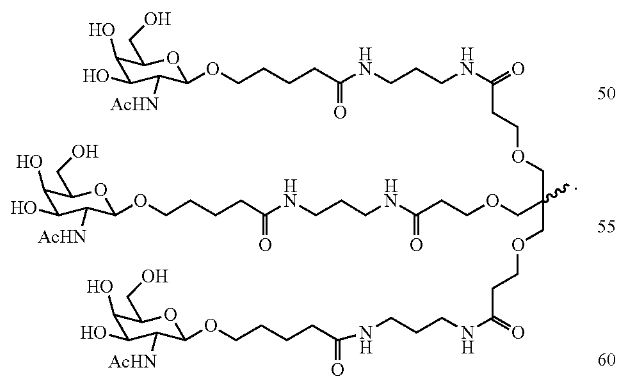

Another representative carbohydrate conjugate for use in the embodiments described herein includes, but is not limited to, (Formula XXXVI)

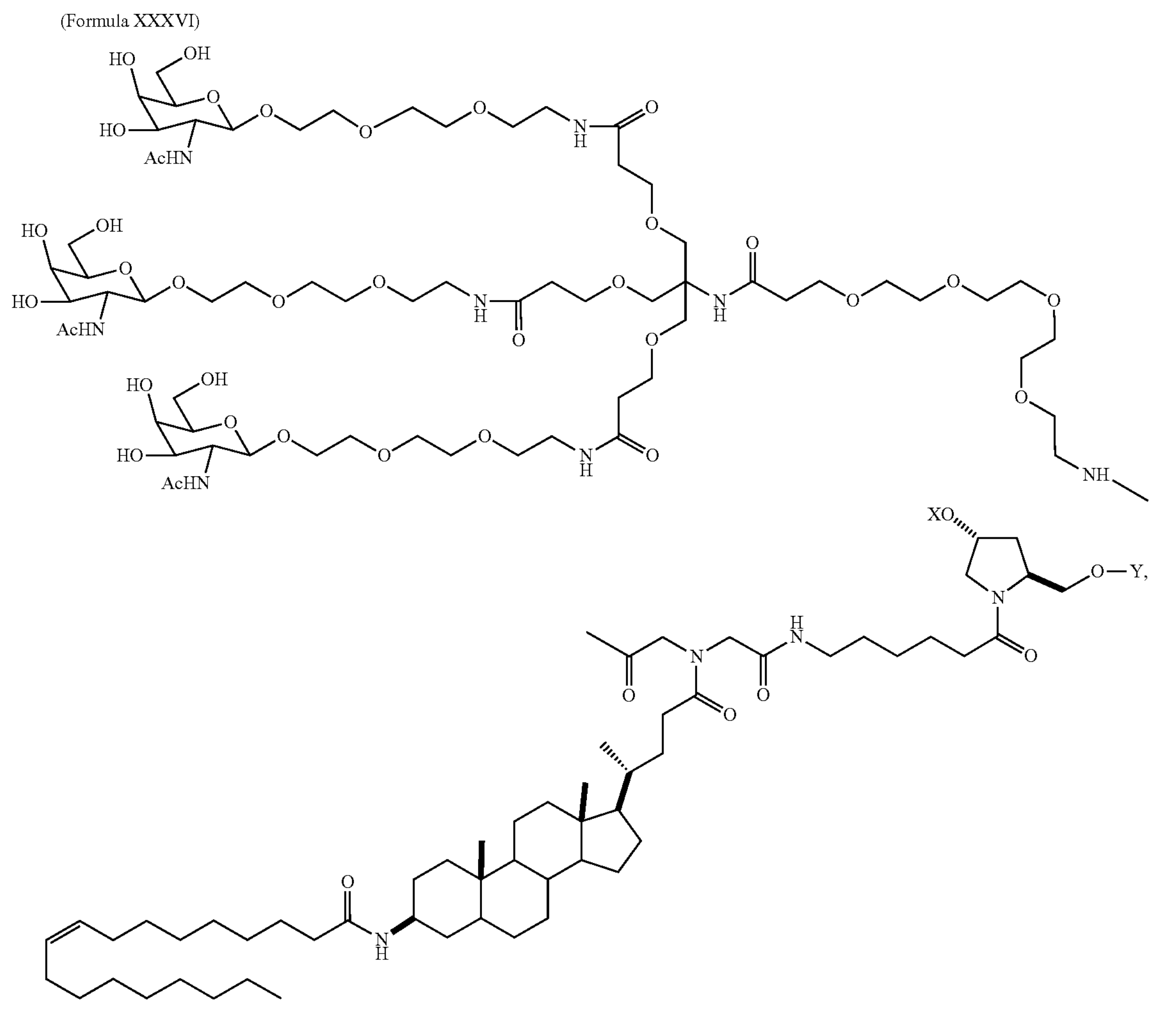

when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

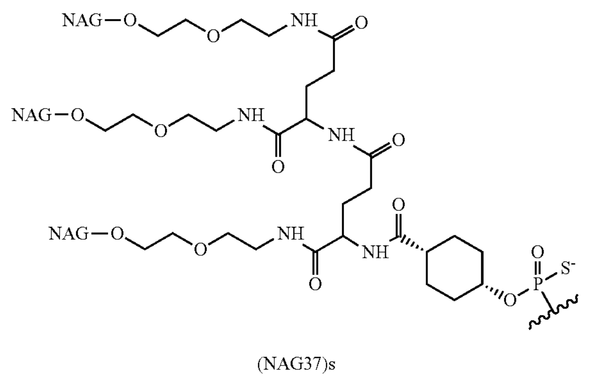

(NAG37)s

In certain embodiments, the RNAi agents of the disclosure may include GalNAc ligands, even if such GalNAc ligands are currently projected to be of limited value for the preferred intrathecal/CNS delivery route(s) of the instant disclosure.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In certain embodiments, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In certain embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In certain embodiments, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Cleavable Linking Groups

In certain embodiments, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleavable Linking Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to.

(Formula XXXVII)

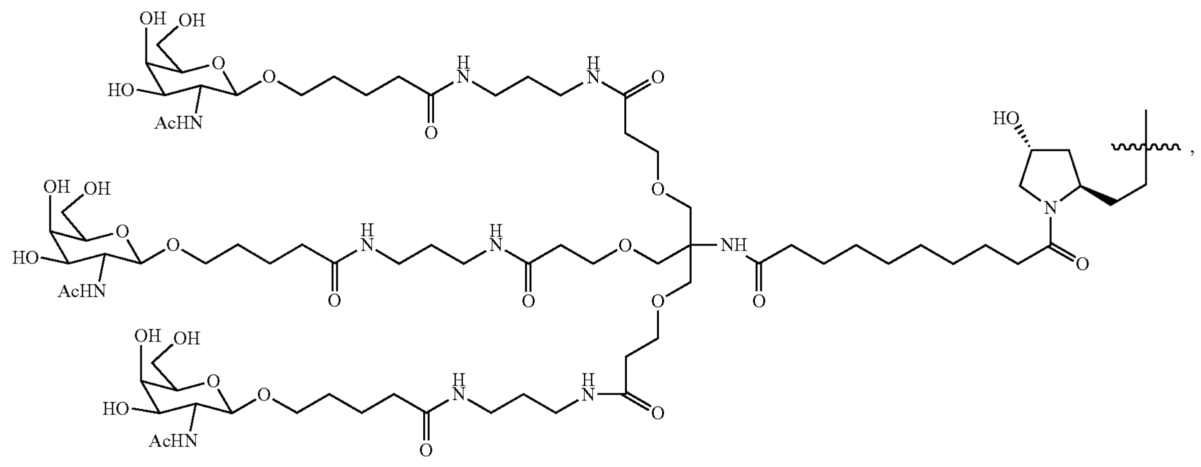

,

-continued
(Formula XXXVIII)
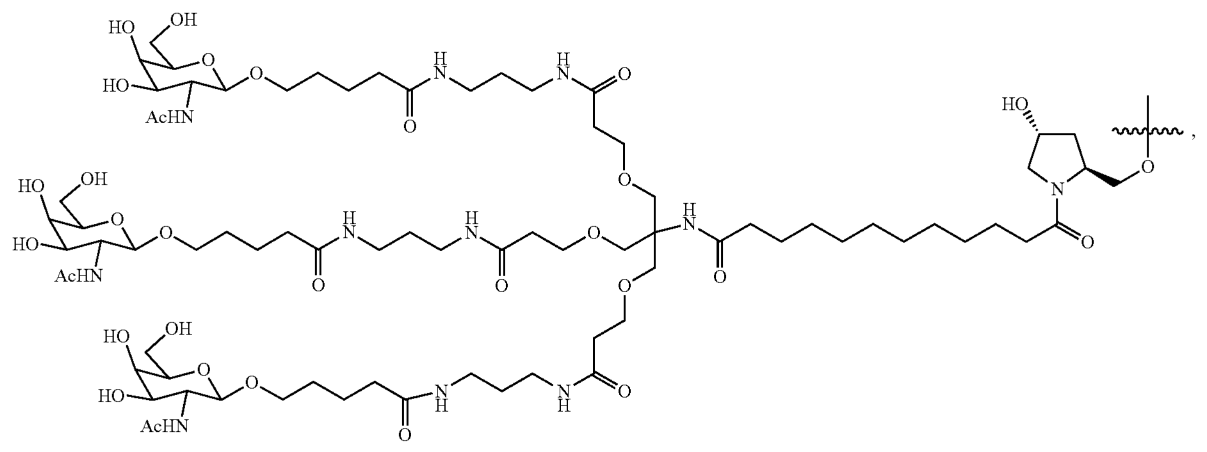
(Formula XXXIX)
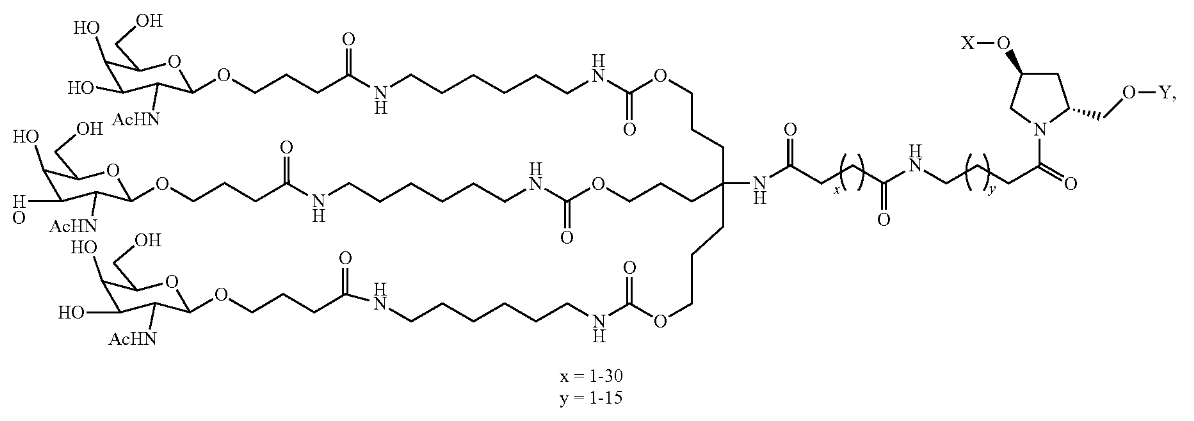
x = 1-30
y = 1-15
(Formula XL)
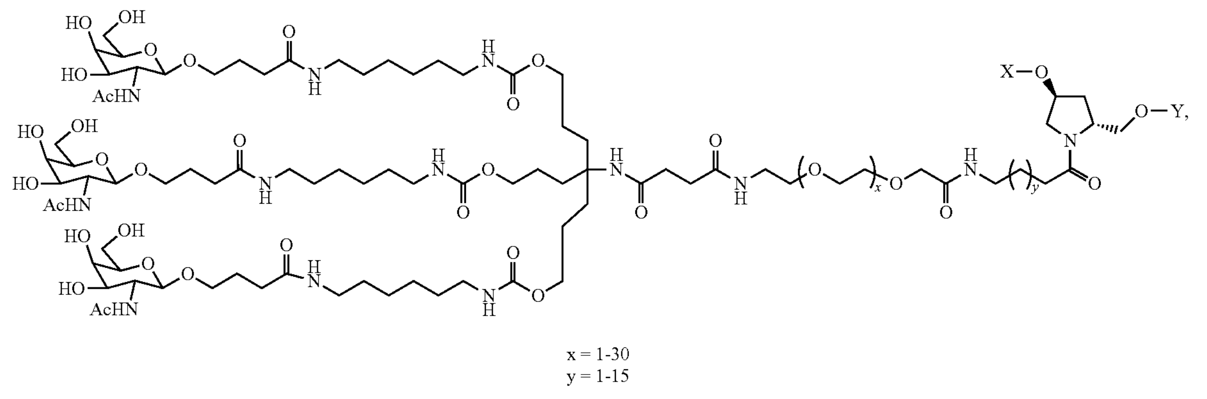
x = 1-30
y = 1-15

-continued
(Formula XLI)
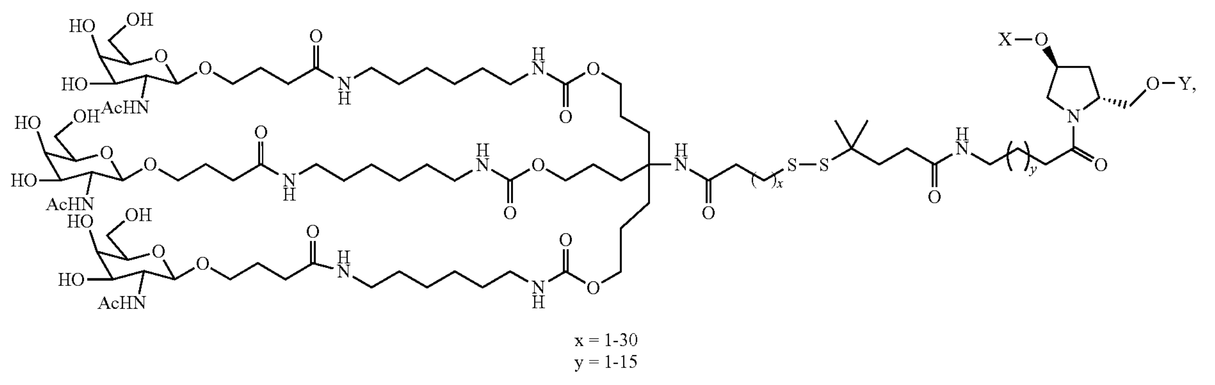
x = 1-30
y = 1-15
(Formula XLII)
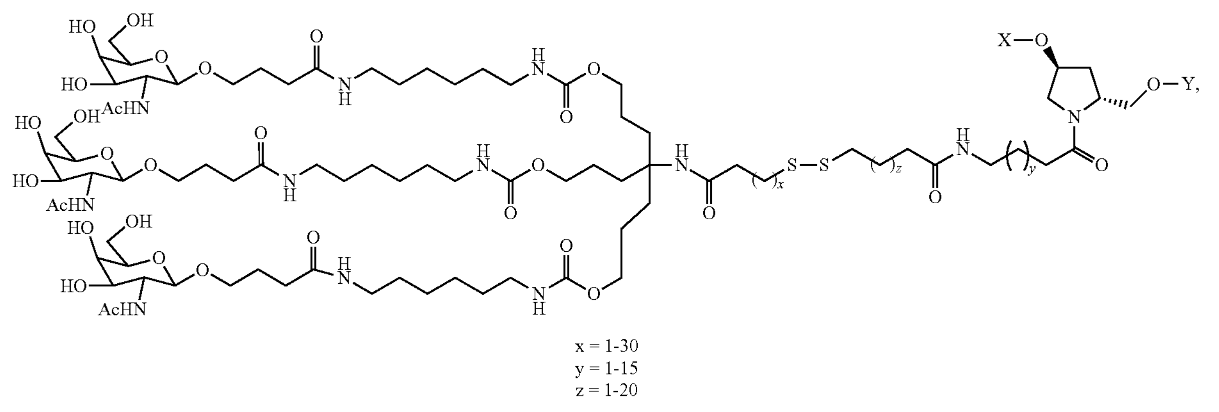
x = 1-30
y = 1-15
z = 1-20
(Formula XLIII)
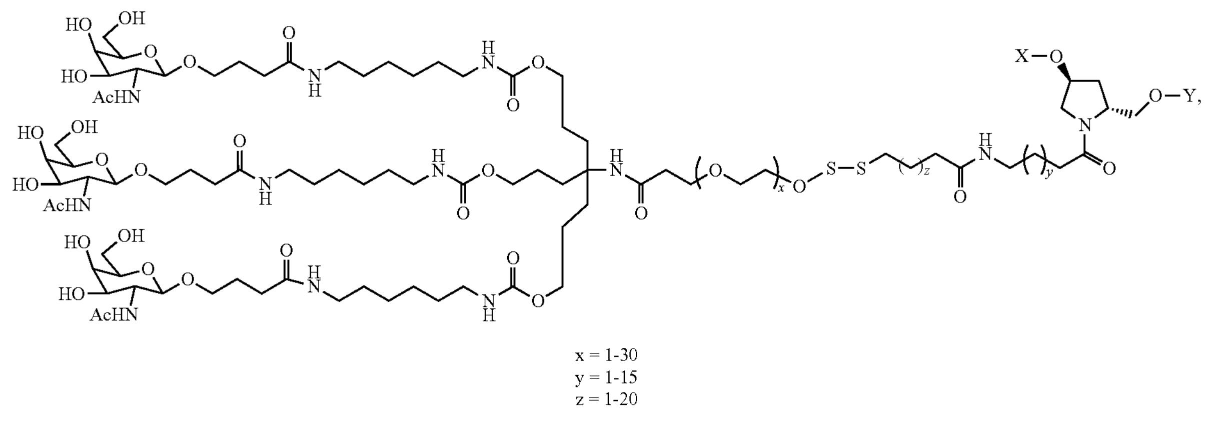
x = 1-30
y = 1-15
z = 1-20
and
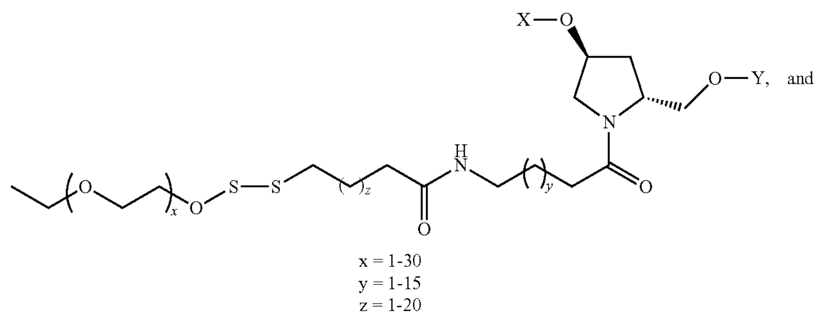
, and
x = 1-30
y = 1-15
z = 1-20

-continued (Formula XLIV)

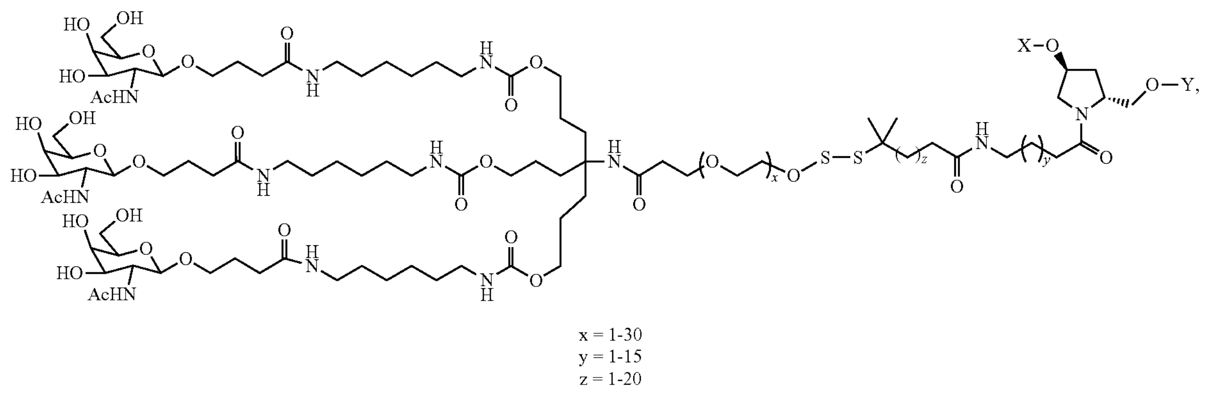

x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In certain embodiments, a dsRNA of the invention is conjugated to a bivalent or trivalent branched linker selected from the group of structures shown in any of formula (XLV)-(XLVI):

Formula XXXXV (IV)

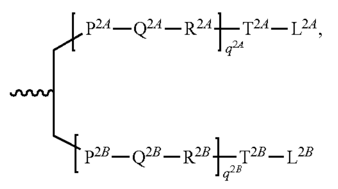

Formula XLVI

V)

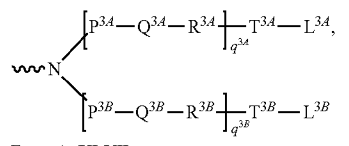

Formula XLVII

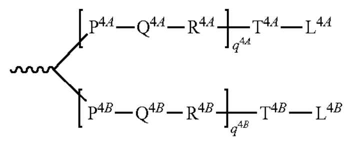

Formula XLVIII

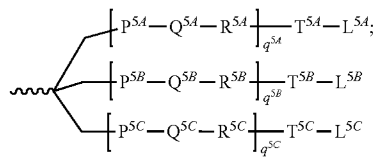

wherein:

q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), CM, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R''), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, $—C(O)—CH(R^a)—NH—$, CO, CH=N—O,

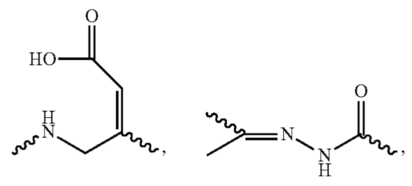

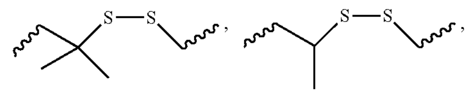

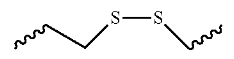

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

Formula XLIX

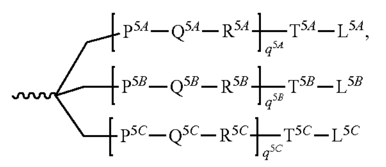

Form wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNA agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N.Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. Delivery of an RNAi Agent of the Disclosure

The delivery of an RNAi agent of the disclosure to a cell e.g., a cell within a subject, such as a human subject (e.g., a subject in need thereof, such as a subject having an HTT-associated disorder, e.g., Huntington's disease, can be achieved in a number of different ways. For example, delivery may be performed by contacting a cell with an RNAi agent of the disclosure either in vitro or in vivo. In vivo delivery may also be performed directly by administering a composition comprising an RNAi agent, e.g., a dsRNA, to a subject. Alternatively, in vivo delivery may be performed indirectly by administering one or more vectors that encode and direct the expression of the RNAi agent. These alternatives are discussed further below.

In general, any method of delivering a nucleic acid molecule (in vitro or in vivo) can be adapted for use with an RNAi agent of the disclosure (see e.g., Akhtar S. and Julian R L., (1992) *Trends Cell. Biol.* 2(5):139-144 and WO94/02595, which are incorporated herein by reference in their entireties). For in vivo delivery, factors to consider in order to deliver an RNAi agent include, for example, biological stability of the delivered agent, prevention of non-specific effects, and accumulation of the delivered agent in the target tissue. The non-specific effects of an RNAi agent can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the RNAi agent to be administered. Several studies have shown successful knockdown of gene products when an RNAi agent is administered locally. For example, intraocular delivery of a VEGF dsRNA by intravitreal injection in cynomolgus monkeys (Tolentino, M J. et al., (2004) *Retina* 24:132-138) and subretinal injections in mice (Reich, S J. et al. (2003) *Mol. Vis.* 9:210-216) were both shown to prevent neovascularization in an experimental model of age-related macular degeneration. In addition, direct intratumoral injection of a dsRNA in mice reduces tumor volume (Pille, J. et al. (2005) *Mol. Ther.* 11:267-274) and can prolong survival of tumor-bearing mice (Kim, W J. et al., (2006) *Mol. Ther.* 14:343-350; Li, S. et al., (2007) *Mol. Ther.* 15:515-523). RNA interference has also shown success with local delivery to the CNS by direct injection (Dorn, G. et al., (2004) *Nucleic Acids* 32:e49; Tan, P H. et al. (2005) *Gene Ther.* 12:59-66; Makimura, H. et al (2002) *BMC Neurosci.* 3:18; Shishkina, G T., et al. (2004) *Neuroscience* 129:521-528; Thakker, E R., et al. (2004) *Proc. Natl. Acad. Sci.* U.S.A. 101:17270-17275; Akaneya, Y., et al. (2005) *J. Neurophysiol.* 93:594-602) and to the lungs by intranasal administration (Howard, K A. et al., (2006) *Mol. Ther.* 14:476-484; Zhang, X. et al., (2004) *J. Biol. Chem.* 279:10677-10684; Bitko, V. et al., (2005) *Nat. Med.* 11:50-55). For administering an RNAi agent systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the RNAi agent to the target tissue and avoid undesirable off-target effects (e.g., without wishing to be bound by theory, use of GNAs as described herein has been identified to destabilize the seed region of a dsRNA, resulting in enhanced preference of such dsRNAs for on-target effectiveness, relative to off-target effects, as such off-target effects are significantly weakened by such seed region destabilization). RNAi agents can be modified by chemical conjugation to lipophilic groups such as cholesterol to enhance cellular uptake and prevent degradation. For example, an RNAi agent directed against ApoB conjugated to a lipophilic cholesterol moiety was injected systemically into mice and resulted in knockdown of apoB mRNA in both the liver and jejunum (Soutschek, J. et al., (2004) *Nature* 432:173-178). Conjugation of an RNAi agent to an aptamer has been shown to inhibit tumor growth and mediate tumor regression in a mouse model of prostate cancer (McNamara, J O. et al., (2006) *Nat. Biotechnol.* 24:1005-1015). In an alternative embodiment, the RNAi agent can be delivered using drug delivery systems such as a nanoparticle, a dendrimer, a polymer, liposomes, or a cationic delivery system. Positively charged cationic delivery systems facilitate binding of molecule RNAi agent (negatively charged) and also enhance interactions at the negatively charged cell membrane to permit efficient uptake of an RNAi agent by the cell. Cationic lipids, dendrimers, or polymers can either be bound to an RNAi agent, or induced to form a vesicle or micelle (see e.g., Kim S H. et al., (2008) *Journal of Controlled Release* 129(2):107-116) that encases an RNAi agent. The formation of vesicles or micelles further prevents degradation of the RNAi agent when administered systemically. Methods for making and administering cationic-RNAi agent complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al. (2007) *J. Hypertens.* 25:197-205, which are incorporated herein by reference in their entirety). Some non-limiting examples of drug delivery systems useful for systemic delivery of RNAi agents include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, an RNAi agent forms a complex with cyclodextrin for systemic administration. Methods for administration and pharmaceutical compositions of RNAi agents and cyclodextrins can be found in U.S. Pat. No. 7,427,605, which is herein incorporated by reference in its entirety.

Certain aspects of the instant disclosure relate to a method of reducing the expression of an HTT target gene in a cell, comprising contacting said cell with the double-stranded RNAi agent of the disclosure. In one embodiment, the cell is an extrahepatic cell, optionally a CNS cell.

Another aspect of the disclosure relates to a method of reducing the expression of an HTT target gene in a subject, comprising administering to the subject the double-stranded RNAi agent of the disclosure.

Another aspect of the disclosure relates to a method of treating a subject having a CNS disorder, comprising administering to the subject a therapeutically effective amount of the double-stranded HTT-targeting RNAi agent of the disclosure, thereby treating the subject. Exemplary CNS disorders that can be treated by the method of the disclosure include Huntington's disease.

In one embodiment, the double-stranded RNAi agent is administered intrathecally. By intrathecal administration of the double-stranded RNAi agent, the method can reduce the expression of an HTT target gene in a brain (e.g., striatum) or spine tissue, for instance, cortex, cerebellum, cervical spine, lumbar spine, and thoracic spine.

For ease of exposition the formulations, compositions and methods in this section are discussed largely with regard to modified siRNA compounds. It may be understood, however, that these formulations, compositions and methods can be practiced with other siRNA compounds, e.g., unmodified siRNA compounds, and such practice is within the disclosure. A composition that includes an RNAi agent can be delivered to a subject by a variety of routes. Exemplary routes include: intrathecal, intravenous, topical, rectal, anal, vaginal, nasal, pulmonary, and ocular.

The RNAi agents of the disclosure can be incorporated into pharmaceutical compositions suitable for administration. Such compositions typically include one or more species of RNAi agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present disclosure may be administered in a number of ways depending upon whether local or systemic treatment is desired and upon the area to be treated. Administration may be topical (including ophthalmic, vaginal, rectal, intranasal, transdermal), oral, or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the RNAi agent in aerosol form. The vascular endothelial cells could be targeted by coating a balloon catheter with the RNAi agent and mechanically introducing the RNA.

Formulations for topical administration may include transdermal patches, ointments, lotions, creams, gels, drops, suppositories, sprays, liquids, and powders. Conventional pharmaceutical carriers, aqueous, powder or oily bases, thickeners and the like may be necessary or desirable. Coated condoms, gloves and the like may also be useful.

Compositions for oral administration include powders or granules, suspensions or solutions in water, syrups, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening or flavoring agents can be added.

Compositions for intrathecal or intraventricular administration may include sterile aqueous solutions which may also contain buffers, diluents, and other suitable additives.

Formulations for parenteral administration may include sterile aqueous solutions which may also contain buffers, diluents, and other suitable additives. Intraventricular injection may be facilitated by an intraventricular catheter, for example, attached to a reservoir. For intravenous use, the total concentration of solutes may be controlled to render the preparation isotonic.

In one embodiment, the administration of the siRNA compound, e.g., a double-stranded siRNA compound, or ssiRNA compound, composition is parenteral, e.g., intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral, or ocular. Administration can be provided by the subject or by another person, e.g., a health care provider. The medication can be provided in measured doses or in a dispenser which delivers a metered dose. Selected modes of delivery are discussed in more detail below.

A. Intrathecal Administration.

In one embodiment, the double-stranded RNAi agent is delivered by intrathecal injection (i.e., injection into the spinal fluid which bathes the brain and spinal cord tissue). Intrathecal injection of RNAi agents into the spinal fluid can be performed as a bolus injection or via minipumps which can be implanted beneath the skin, providing a regular and constant delivery of siRNA into the spinal fluid. The circulation of the spinal fluid from the choroid plexus, where it is produced, down around the spinal chord and dorsal root ganglia and subsequently up past the cerebellum and over the cortex to the arachnoid granulations, where the fluid can exit the CNS, that, depending upon size, stability, and solubility of the compounds injected, molecules delivered intrathecally could hit targets throughout the entire CNS.

In some embodiments, the intrathecal administration is via a pump. The pump may be a surgically implanted osmotic pump. In one embodiment, the osmotic pump is implanted into the subarachnoid space of the spinal canal to facilitate intrathecal administration.

In some embodiments, the intrathecal administration is via an intrathecal delivery system for a pharmaceutical including a reservoir containing a volume of the pharmaceutical agent, and a pump configured to deliver a portion of the pharmaceutical agent contained in the reservoir. More details about this intrathecal delivery system may be found in WO 2015/116658, which is incorporated by reference in its entirety.

The amount of intrathecally injected RNAi agents may vary from one target gene to another target gene and the appropriate amount that has to be applied may have to be determined individually for each target gene. Typically, this amount ranges from 10 μg to 2 mg, preferably 50 μg to 1500 μg, more preferably 100 μg to 1000 μg.

B. Vector Encoded RNAi Agents of the Disclosure

RNAi agents targeting the HTT gene can be expressed from transcription units inserted into DNA or RNA vectors (see, e.g., Couture, A, et al., *TIG*. (1996), 12:5-10; WO 00/22113, WO 00/22114, and U.S. Pat. No. 6,054,299). Expression is preferably sustained (months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of an RNAi agent can be transcribed from a promoter on an expression vector. Where two separate strands are to be expressed to generate, for example, a dsRNA, two separate expression vectors can be co-introduced (e.g., by transfection or infection) into a target cell. Alternatively, each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

RNAi agent expression vectors are generally DNA plasmids or viral vectors. Expression vectors compatible with eukaryotic cells, preferably those compatible with vertebrate cells, can be used to produce recombinant constructs for the expression of an RNAi agent as described herein. Delivery of RNAi agent expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an RNAi agent will generally require regulatory elements, e.g., promoters, enhancers, etc., to ensure the expression of the RNAi agent in target cells. Other aspects to consider for vectors and constructs are known in the art.

VI. Pharmaceutical Compositions of the Invention

The present disclosure also includes pharmaceutical compositions and formulations which include the RNAi agents of the disclosure. In one embodiment, provided herein are pharmaceutical compositions containing an RNAi agent, as described herein, and a pharmaceutically acceptable carrier. The pharmaceutical compositions containing the RNAi agent are useful for treating a disease or disorder associated with the expression or activity of HTT, e.g., Huntington's disease.

In some embodiments, the pharmaceutical compositions of the invention are sterile. In another embodiment, the pharmaceutical compositions of the invention are pyrogen free or non-pyrogenic.

Such pharmaceutical compositions are formulated based on the mode of delivery. One example is compositions that are formulated for systemic administration via parenteral delivery, e.g., by intravenous (IV), intramuscular (IM), or for subcutaneous (subQ) delivery. Another example is compositions that are formulated for direct delivery into the CNS, e.g., by intrathecal or intravitreal routes of injection, optionally by infusion into the brain (e.g., striatum), such as by continuous pump infusion.

The pharmaceutical compositions of the disclosure may be administered in dosages sufficient to inhibit expression of an HTT gene. In general, a suitable dose of an RNAi agent of the disclosure will be in the range of about 0.001 to about 200.0 milligrams per kilogram body weight of the recipient per day, generally in the range of about 1 to 50 mg per kilogram body weight per day.

A repeat-dose regimen may include administration of a therapeutic amount of an RNAi agent on a regular basis, such as monthly to once every six months. In certain embodiments, the RNAi agent is administered about once per quarter (i.e., about once every three months) to about twice per year.

After an initial treatment regimen (e.g., loading dose), the treatments can be administered on a less frequent basis.

In other embodiments, a single dose of the pharmaceutical compositions can be long lasting, such that subsequent doses are administered at not more than 1, 2, 3, or 4 or more month intervals. In some embodiments of the disclosure, a single dose of the pharmaceutical compositions of the disclosure is administered once per month. In other embodiments of the disclosure, a single dose of the pharmaceutical compositions of the disclosure is administered once per quarter to twice per year.

The skilled artisan will appreciate that certain factors can influence the dosage and timing required to effectively treat a subject, including but not limited to the severity of the disease or disorder, previous treatments, the general health or age of the subject, and other diseases present. Moreover, treatment of a subject with a therapeutically effective amount of a composition can include a single treatment or a series of treatments.

Advances in mouse genetics have generated a number of mouse models for the study of various human diseases, such as HD that would benefit from reduction in the expression of HTT. Such models can be used for in vivo testing of RNAi agents, as well as for determining a therapeutically effective dose. Suitable rodent models are known in the art and include, for example, those described in, for example, Cepeda, et al. (*ASN Neuro* (2010) 2(2):e00033) and Pouladi, et al. (*Nat Reviews* (2013) 14:708).

The pharmaceutical compositions of the present disclosure can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The RNAi agents can be delivered in a manner to target a particular tissue, such as the CNS (e.g., neuronal, glial or vascular tissue of the brain).

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the RNAi agents featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, disteroylphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). RNAi agents featured in the disclosure can be encapsulated within liposomes or can form complexes thereto, in particular to cationic liposomes. Alternatively, RNAi agents can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

A. RNAi Agent Formulations Comprising Membranous Molecular Assemblies

An RNAi agent for use in the compositions and methods of the disclosure can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the RNAi agent composition. The lipophilic material isolates the aqueous interior from an aqueous exterior, which typically does not include the RNAi agent composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the RNAi agent are delivered into the cell where the RNAi agent can specifically bind to a target RNA and can mediate RNAi. In some cases the liposomes are also specifically targeted, e.g., to direct the RNAi agent to particular cell types.

A liposome containing an RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., (1987) *Proc. Natl. Acad. Sci. USA* 8:7413-7417; U.S. Pat. Nos. 4,897,355; 5,171,678; Bangham et al., (1965) *M. Mol. Biol.* 23:238; Olson et al., (1979) *Biochim. Biophys. Acta* 557:9; Szoka et al., (1978) *Proc. Natl. Acad. Sci.* 75: 4194; Mayhew et al., (1984) *Biochim. Biophys. Acta* 775:169; Kim et al., (1983) *Biochim. Biophys. Acta* 728:339; and Fukunaga et al., (1984) *Endocrinol.* 115:757. Commonly used techniques for preparing lipid aggregates of appropriate size for use as delivery vehicles include sonication and freeze-thaw plus extrusion (see, e.g., Mayer et al., (1986) *Biochim. Biophys. Acta* 858:161. Microfluidization can be used when consistently small (50 to 200 nm) and relatively uniform aggregates are desired (Mayhew et al., (1984) *Biochim. Biophys. Acta* 775:169. These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) *Biochem. Biophys. Res. Commun.,* 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) *Journal of Controlled Release,* 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid or phosphatidylcholine or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, (1994) *J. Biol. Chem.* 269:2550; Nabel, (1993) *Proc. Natl. Acad. Sci.* 90:11307; Nabel, (1992) *Human Gene Ther.* 3:649; Gershon, (1993) *Biochem.* 32:7143; and Strauss, (1992) *EMBO J.* 11:417.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al., (1994) *S.T.P. Pharma. Sci.,* 4(6):466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) *FEBS Letters,* 223:42; Wu et al., (1993) *Cancer Research,* 53:3765).

Various liposomes comprising one or more glycolipids are known in the art. Papahadjopoulos et al. (*Ann. N.Y. Acad. Sci.*, (1987), 507:64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, (1988), 85:6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., (1987) *Proc. Natl. Acad. Sci. USA* 8:7413-7417, and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Indiana) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wisconsin) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., (1991) *Biochim. Biophys. Res. Commun.* 179:280). Lipopolylysine, made by conjugating polylysine to DOPE, has been reported to be effective for transfection in the presence of serum (Zhou, X. et al., (1991) *Biochim. Biophys. Acta* 1065:8). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, California) and Lipofectamine (DOSPA) (Life Technology, Inc., Gaithersburg, Maryland). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., (1992) *Journal of Drug Targeting*, vol. 2, 405-410 and du Plessis et al., (1992) *Antiviral Research,* 18:259-265; Mannino, R. J. and Fould-Fogerite, S., (1998) *Biotechniques* 6:682-690; Itani, T. et al., (1987) *Gene* 56:267-276; Nicolau, C. et al. (1987) *Meth. Enzymol.* 149: 157-176; Straubinger, R. M. and Papahadjopoulos, D. (1983) *Meth. Enzymol.* 101:512-527; Wang, C. Y. and Huang, L., (1987) *Proc. Natl. Acad. Sci. USA* 84:7851-7855).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include RNAi agents can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present disclosure are described in U.S. provisional application Ser. No. 61/018,616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application number PCT/US2007/080331, filed Oct. 3, 2007, also describes formulations that are amenable to the present disclosure.

Transfersomes, yet another type of liposomes, are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as those described herein, particularly in emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The RNAi agent for use in the methods of the disclosure can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to C22 alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol or m-cresol may be added to the mixed micellar composition to stabilize the formulation and protect against bacterial growth. Alternatively, phenol or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles

RNAi agents, e.g., dsRNAs of in the disclosure may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in WO 00/03683. The particles of the present disclosure typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present disclosure are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; United States Patent publication No. 2010/0324120 and WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the disclosure.

Certain specific LNP formulations for delivery of RNAi agents have been described in the art, including, e.g., "LNP01" formulations as described in, e.g., WO 2008/042973, which is hereby incorporated by reference.

Additional exemplary lipid-dsRNA formulations are identified in the table below.

| | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |

-continued

| | Ionizable/Cationic Lipid | cationic lipid/non-cationic lipid/cholesterol/PEG-lipid conjugate Lipid:siRNA ratio |
|---|---|---|
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine

DPPC: dipalmitoylphosphatidylcholine

PEG-DMG: PEG-didimyristoyl glycerol (C14-PEG, or PEG-C14) (PEG with avg mol wt of 2000)

PEG-DSG: PEG-distyryl glycerol (C18-PEG, or PEG-C18) (PEG with avg mol wt of 2000)

PEG-cDMA: PEG-carbamoyl-1,2-dimyristyloxypropylamine (PEG with avg mol wt of 2000)

SNALP (l,2-Dilinolenyloxy-N,N-dimethylaminopropane (DLinDMA)) comprising formulations are described in WO 2009/127060, which is hereby incorporated by reference.

XTC comprising formulations are described in WO 2010/088537, the entire contents of which are hereby incorporated herein by reference.

MC3 comprising formulations are described, e.g., in U.S. patent Publication No. 2010/0324120, the entire contents of which are hereby incorporated by reference.

ALNY-100 comprising formulations are described in WO 2010/054406, the entire contents of which are hereby incorporated herein by reference.

C12-200 comprising formulations are described in WO 2010/129709, the entire contents of which are hereby incorporated herein by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the disclosure are administered in conjunction with one or more penetration enhancer surfactants and chelators. Suitable surfactants include fatty acids or esters or salts thereof, bile acids or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the disclosure can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, U.S. 2003/0027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the brain when treating APP-associated diseases or disorders.

The pharmaceutical formulations of the present disclosure, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present disclosure can be formulated into any of many possible dosage forms such as, but not limited to, tablets, capsules, gel capsules, liquid syrups, soft gels, suppositories, and enemas. The compositions of the present disclosure can also be formulated as suspensions in aqueous, non-aqueous or mixed media. Aqueous suspensions can further contain substances which increase the viscosity of the suspension including, for example, sodium carboxymethylcellulose, sorbitol or dextran. The suspension can also contain stabilizers.

C. Additional Formulations i. Emulsions

The compositions of the present disclosure can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise, a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present disclosure, the compositions of RNAi agents and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically, microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used, and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sesquioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or RNAi agents. Microemulsions have also been effective in the transdermal delivery of active components in both cosmetic and pharmaceutical applications. It is expected that the microemulsion compositions and formulations of the present disclosure will facilitate the increased systemic absorption of RNAi agents and nucleic acids from the gastrointestinal tract, as well as improve the local cellular uptake of RNAi agents and nucleic acids.

Microemulsions of the present disclosure can also contain additional components and additives such as sorbitan monostearate (Grill 3), Labrasol, and penetration enhancers to improve the properties of the formulation and to enhance the absorption of the RNAi agents and nucleic acids of the present disclosure. Penetration enhancers used in the microemulsions of the present disclosure can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the disclosure may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present disclosure employs various penetration enhancers to effect the efficient delivery of nucleic acids, particularly RNAi agents, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of RNAi agents through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, NY, 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, MA, 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., *McGraw-Hill*, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present disclosure, can be defined as compounds that remove metallic ions from solution by forming complexes therewith, with the result that absorption of RNAi agents through the mucosa is enhanced. With regards to their use as penetration enhancers in the present disclosure, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, MA, 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rd., 1990, 14, 43-51).

As used herein, non-chelating non-surfactant penetration enhancing compounds can be defined as compounds that demonstrate insignificant activity as chelating agents or as surfactants but that nonetheless enhance absorption of RNAi agents through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacycloalkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of RNAi agents at the cellular level can also be added to the pharmaceutical and other compositions of the present disclosure. For example, cationic lipids, such as lipofectin (Junichi et al, U.S. Pat. No. 5,705,188), cationic glycerol derivatives, and polycationic molecules, such as polylysine (WO 97/30731), are also known to enhance the cellular uptake of dsRNAs.

Other agents can be utilized to enhance the penetration of the administered nucleic acids, including glycols such as ethylene glycol and propylene glycol, pyrrols such as 2-pyrrol, azones, and terpenes such as limonene and menthone.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present disclosure. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present disclosure can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present disclosure, such as dyes, flavoring agents, preservatives, antioxidants, opacifiers, thickening agents and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, colorings, flavorings or aromatic substances and the like which do not deleteriously interact with the nucleic acid(s) of the formulation.

Aqueous suspensions can contain substances which increase the viscosity of the suspension including, for example, sodium carboxymethylcellulose, sorbitol or dextran. The suspension can also contain stabilizers.

In some embodiments, pharmaceutical compositions featured in the disclosure include (a) one or more RNAi agents and (b) one or more agents which function by a non-RNAi mechanism and which are useful in treating an HTT-associated disorder. Examples of such agents include, but are not limited to, monoamine inhibitors, reserpine, anticonvulsants, antipsychotic agents, and antidepressants.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$ Compounds that exhibit high therapeutic indices are preferred.

The data obtained from cell culture assays and animal studies can be used in formulating a range of dosage for use in humans. The dosage of compositions featured herein in the disclosure lies generally within a range of circulating concentrations that include the $ED_{50}$ with little or no toxicity. The dosage can vary within this range depending upon the dosage form employed and the route of administration utilized. For any compound used in the methods featured in the disclosure, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the RNAi agents featured in the disclosure can be administered in combination with other known agents effective in treatment of pathological processes mediated by nucleotide repeat expression. In any event, the administering physician can adjust the amount and timing of RNAi agent administration on the basis of results observed using standard measures of efficacy known in the art or described herein.

VII. Kits

In certain aspects, the instant disclosure provides kits that include a suitable container containing a pharmaceutical formulation of a siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe), or means for measuring the inhibition of C3 (e.g., means for measuring the inhibition of HTT mRNA, HTT protein, and/or HTT activity). Such means for measuring the inhibition of HTT may comprise a means for obtaining a sample from a subject, such as, e.g., a CSF and/or plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

VII. Methods for Inhibiting HTT Expression

The present disclosure also provides methods of inhibiting expression of an HTT gene in a cell. The methods include contacting a cell with an RNAi agent, e.g., double stranded RNAi agent, in an amount effective to inhibit expression of HTT in the cell, thereby inhibiting expression of HTT in the cell. In certain embodiments of the disclosure, HTT is inhibited preferentially in CNS (e.g., brain) cells.

Contacting of a cell with an RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible.

Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc ligand, or any other ligand that directs the RNAi agent to a site of interest.

The term "inhibiting," as used herein, is used interchangeably with "reducing," "silencing," "downregulating," "suppressing" and other similar terms, and includes any level of inhibition. In certain embodiments, a level of inhibition, e.g., for an RNAi agent of the instant disclosure, can be assessed in cell culture conditions, e.g., wherein cells in cell culture are transfected via Lipofectamine™-mediated transfection at a concentration in the vicinity of a cell of 10 nM or less, 1 nM or less, etc. Knockdown of a given RNAi agent can be determined via comparison of pre-treated levels in cell culture versus post-treated levels in cell culture, optionally also comparing against cells treated in parallel with a scrambled or other form of control RNAi agent. Knockdown in cell culture of, e.g., preferably 50% or more, can thereby be identified as indicative of "inhibiting" or "reducing", "downregulating" or "suppressing", etc. having occurred. It is expressly contemplated that assessment of targeted mRNA or encoded protein levels (and therefore an extent of "inhibiting", etc. caused by an RNAi agent of the disclosure) can also be assessed in in vivo systems for the RNAi agents of the instant disclosure, under properly controlled conditions as described in the art.

The phrase "inhibiting expression of an HTT gene" or "inhibiting expression of HTT," as used herein, includes inhibition of expression of any HTT gene (such as, e.g., a mouse HTT gene, a rat HTT gene, a monkey HTT gene, or a human HTT gene) as well as variants or mutants of an HTT gene that encode an HTT protein. Thus, the HTT gene may be a wild-type HTT gene, a mutant HTT gene, or a transgenic HTT gene in the context of a genetically manipulated cell, group of cells, or organism.

"Inhibiting expression of an HTT gene" includes any level of inhibition of an HTT gene, e.g., at least partial suppression of the expression of an HTT gene, such as an inhibition by at least 20%. In certain embodiments, inhibition is by at least 30%, at least 40%, preferably at least 50%, at least about 60%, at least 70%, at least about 80%, at least 85%, at least 90%, at least 95%, at least 96%, at least 97%, at least 98%, or at least 99%; or to below the level of detection of the assay method.

The expression of an HTT gene may be assessed based on the level of any variable associated with HTT gene expression, e.g., HTT mRNA level or HTT protein level, or, for example, the level of C9orf72 expanded protein.

Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the disclosure, expression of an HTT gene is inhibited by at least 20%, 30%, 40%, preferably at least 50%, 60%, 70%, 80%, 85%, 90%, or 95%, or to below the level of detection of the assay. In certain embodiments, the methods include a clinically relevant inhibition of expression of HTT, e.g. as demonstrated by a clinically relevant outcome after treatment of a subject with an agent to reduce the expression of HTT.

Inhibition of the expression of an HTT gene may be manifested by a reduction of the amount of mRNA expressed by a first cell or group of cells (such cells may be present, for example, in a sample derived from a subject) in which an HTT gene is transcribed and which has or have been treated (e.g., by contacting the cell or cells with an RNAi agent of the disclosure, or by administering an RNAi agent of the disclosure to a subject in which the cells are or were present) such that the expression of an HTT gene is inhibited, as compared to a second cell or group of cells substantially identical to the first cell or group of cells but which has not or have not been so treated (control cell(s) not treated with an RNAi agent or not treated with an RNAi agent targeted to the gene of interest). The degree of inhibition may be expressed in terms of:

$$\frac{(mRNA \text{ in control cells}) - (mRNA \text{ in treated cells})}{(mRNA \text{ in control cells})} \cdot 100\%$$

In other embodiments, inhibition of the expression of an HTT gene may be assessed in terms of a reduction of a parameter that is functionally linked to an HTT gene expression, e.g., HTT protein expression. HTT gene silencing may be determined in any cell expressing HTT, either endogenous or heterologous from an expression construct, and by any assay known in the art.

Inhibition of the expression of an HTT protein may be manifested by a reduction in the level of the HTT protein that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of an HTT gene includes a cell or group of cells that has not yet been contacted with an RNAi agent of the disclosure. For example, the control cell or group of cells may be derived from an individual subject (e.g., a human or animal subject) prior to treatment of the subject with an RNAi agent.

The level of HTT mRNA that is expressed by a cell or group of cells may be determined using any method known in the art for assessing mRNA expression. In one embodiment, the level of expression of HTT in a sample is determined by detecting a transcribed polynucleotide, or portion thereof, e.g., mRNA of the HTT gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Circulating HTT mRNA may be detected using methods the described in WO2012/177906, the entire contents of which are hereby incorporated herein by reference.

In some embodiments, the level of expression of HTT is determined using a nucleic acid probe. The term "probe", as used herein, refers to any molecule that is capable of selectively binding to a specific HTT nucleic acid or protein, or fragment thereof. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to HTT mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of HTT mRNA.

An alternative method for determining the level of expression of HTT in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the disclosure, the level of expression of HTT is determined by quantitative fluorogenic RT-PCR (i.e., the TaqMan™ System), by a Dual-Glo® Luciferase assay, or by other art-recognized method for measurement of HTT expression or mRNA level.

The expression level of HTT mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of HTT expression level may also comprise using nucleic acid probes in solution.

In some embodiments, the level of mRNA expression is assessed using branched DNA (bDNA) assays or real time PCR (qPCR). The use of this PCR method is described and exemplified in the Examples presented herein. Such methods can also be used for the detection of HTT nucleic acids.

The level of HTT protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like. Such assays can also be used for the detection of proteins indicative of the presence or replication of HTT proteins.

In some embodiments, the efficacy of the methods of the disclosure in the treatment of an HTT-related disease is assessed by a decrease in HTT mRNA level (e.g., by assessment of a CSF sample and/or plasma sample for HTT level, by brain biopsy, or otherwise).

In some embodiments of the methods of the disclosure, the RNAi agent is administered to a subject such that the RNAi agent is delivered to a specific site within the subject. The inhibition of expression of HTT may be assessed using measurements of the level or change in the level of HTT mRNA or HTT protein in a sample derived from a specific site within the subject, e.g., CNS cells. In certain embodiments, the methods include a clinically relevant inhibition of expression of HTT, e.g. as demonstrated by a clinically relevant outcome after treatment of a subject with an agent to reduce the expression of HTT, such as, for example, stabilization or inhibition of caudate atrophy (e.g., as assessed by volumetric MRI (vMRI)), a stabilization or reduction in neurofilament light chain (Nfl) levels in a CSF sample from a subject, a reduction in mutant HTT mRNA or a cleaved mutant HTT protein, e.g., one or both of full-length mutant HTT mRNA or protein and a cleaved mutant HTT mRNA or protein, and a stabilization or improvement in Unified Huntington's Disease Rating Scale (UHDRS) score.

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

IX. Methods of Treating or Preventing HTT-Associated Diseases

The present disclosure also provides methods of using an RNAi agent of the disclosure or a composition containing an RNAi agent of the disclosure to reduce or inhibit HTT expression in a cell. The methods include contacting the cell with a dsRNA of the disclosure and maintaining the cell for a time sufficient to obtain degradation of the mRNA transcript of an HTT gene, thereby inhibiting expression of the HTT gene in the cell. Reduction in gene expression can be assessed by any methods known in the art. For example, a reduction in the expression of HTT may be determined by determining the mRNA expression level of HTT using methods routine to one of ordinary skill in the art, e.g., northern blotting, qRT-PCR; by determining the protein level of HTT using methods routine to one of ordinary skill in the art, such as western blotting, immunological techniques.

In the methods of the disclosure the cell may be contacted in vitro or in vivo, i.e., the cell may be within a subject.

A cell suitable for treatment using the methods of the disclosure may be any cell that expresses an HTT gene. A cell suitable for use in the methods of the disclosure may be a mammalian cell, e.g., a primate cell (such as a human cell or a non-human primate cell, e.g., a monkey cell or a chimpanzee cell), a non-primate cell (such as a rat cell, or a mouse cell). In one embodiment, the cell is a human cell, e.g., a human CNS cell.

HTT expression is inhibited in the cell by at least about 30, 40, 50, 55, 60, 65, 70, 75, 80, 85, 90, 95, 96, 97, 98, 99, or about 100%, i.e., to below the level of detection. In preferred embodiments, HTT expression is inhibited by at least 50%.

The in vivo methods of the disclosure may include administering to a subject a composition containing an RNAi agent, where the RNAi agent includes a nucleotide sequence that is complementary to at least a part of an RNA transcript of the HTT gene of the mammal to be treated. When the organism to be treated is a mammal such as a human, the composition can be administered by any means known in the art including, but not limited to, oral, intraperitoneal, or parenteral routes, including intracranial (e.g., intraventricular, intraparenchymal, and intrathecal), intravenous, intramuscular, intravitreal, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intrathecal injection.

In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of HTT, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intracranial, intravenous, subcutaneous, arterial, or epidural infusions. In preferred embodiments, the infusion pump is a subcutaneous infusion pump. In other embodiments, the pump is a surgically implanted pump that delivers the RNAi agent to the CNS.

The mode of administration may be chosen based upon whether local or systemic treatment is desired and based upon the area to be treated. The route and site of administration may be chosen to enhance targeting.

In one aspect, the present disclosure also provides methods for inhibiting the expression of an HTT gene in a mammal. The methods include administering to the mammal a composition comprising a dsRNA that targets an HTT gene in a cell of the mammal and maintaining the mammal for a time sufficient to obtain degradation of the mRNA transcript of the HTT gene, thereby inhibiting expression of the HTT gene in the cell. Reduction in gene expression can be assessed by any methods known it the art and by methods, e.g. qRT-PCR, described herein. Reduction in protein production can be assessed by any methods known it the art and by methods, e.g. ELISA, described herein. In one embodiment, a CNS biopsy sample or a cerebrospinal fluid (CSF) sample serves as the tissue material for monitoring the reduction in HTT gene or protein expression (or of a proxy therefore).

The present disclosure further provides methods of treatment of a subject in need thereof. The treatment methods of the disclosure include administering an RNAi agent of the disclosure to a subject, e.g., a subject that would benefit from inhibition of HTT expression, in a therapeutically effective amount of an RNAi agent targeting an HTT gene or a pharmaceutical composition comprising an RNAi agent targeting aHTT gene.

In addition, the present disclosure provides methods of preventing, treating or inhibiting the progression of an HTT-associated disease or disorder (e.g., Huntington's disease), in a subject, such as the progression of an HTT-associated disease or disorder. The methods include administering to the subject a therapeutically effective amount of any of the RNAi agent, e.g., dsRNA agents, or the pharmaceutical composition provided herein, thereby preventing, treating or inhibiting the progression of an HTT-associated disease or disorder in the subject.

An RNAi agent of the disclosure may be administered as a "free RNAi agent." A free RNAi agent is administered in the absence of a pharmaceutical composition. The naked RNAi agent may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the RNAi agent can be adjusted such that it is suitable for administering to a subject.

Alternatively, an RNAi agent of the disclosure may be administered as a pharmaceutical composition, such as a dsRNA liposomal formulation.

Subjects that would benefit from a reduction or inhibition of HTT gene expression are those having an HTT-associated disease, e.g., Huntington's disease.

The disclosure further provides methods for the use of an RNAi agent or a pharmaceutical composition thereof, e.g., for treating a subject that would benefit from reduction or inhibition of HTT expression, e.g., a subject having an HTT-associated disorder, in combination with other pharmaceuticals or other therapeutic methods, e.g., with known pharmaceuticals or known therapeutic methods, such as, for example, those which are currently employed for treating these disorders. For example, in certain embodiments, an RNAi agent targeting HTT is administered in combination with, e.g., an agent useful in treating an HTT-associated disorder as described elsewhere herein or as otherwise known in the art. For example, additional agents suitable for treating a subject that would benefit from reduction in HTT expression, e.g., a subject having an HTT-associated disorder, may include agents currently used to treat symptoms of HTT. The RNAi agent and additional therapeutic agents may be administered at the same time or in the same combination, e.g., intrathecally, or the additional therapeutic agent can be administered as part of a separate composition or at separate times or by another method known in the art or described herein.

Exemplary additional therapeutics include, for example, a monoamine inhibitor, e.g., tetrabenazine (Xenazine), deutetrabenazine (Austedo), and reserpine, an anticonvulsant, e.g., valproic acid (Depakote, Depakene, Depacon), and clonazepam (Klonopin), an antipsychotic agent, e.g., risperidone (Risperdal), and haloperidol (Haldol), and an antidepressant, e.g., paroxetine (Paxil).

In one embodiment, the method includes administering a composition featured herein such that expression of the target HTT gene is decreased, for at least one month. In preferred embodiments, expression is decreased for at least 2 months, 3 months, or 6 months.

Preferably, the RNAi agents useful for the methods and compositions featured herein specifically target RNAs (primary or processed) of the target HTT gene. Compositions and methods for inhibiting the expression of these genes using RNAi agents can be prepared and performed as described herein.

Administration of the dsRNA according to the methods of the disclosure may result in a reduction of the severity, signs, symptoms, or markers of such diseases or disorders in a patient with an HTT-associated disorder. By "reduction" in this context is meant a statistically significant or clinically significant decrease in such level. The reduction can be, for example, at least 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of an HTT-associated disorder may be assessed, for example, by periodic monitoring of a subject's. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an RNAi agent targeting HTT or pharmaceutical composition thereof, "effective against" an HTT-associated disorder indicates that administration in a clinically appropriate manner results in a beneficial effect for at least a statistically significant fraction of patients, such as an improvement of symptoms, a cure, a reduction in disease, extension of life, improvement in quality of life, or other effect generally recognized as positive by medical doctors familiar with treating HTT-associated disorders and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given RNAi agent drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale. Any positive change resulting in e.g., lessening of severity of disease measured using the appropriate scale, represents adequate treatment using an RNAi agent or RNAi agent formulation as described herein.

Subjects can be administered a therapeutic amount of dsRNA, such as about 0.01 mg/kg to about 200 mg/kg.

The RNAi agent can be administered intrathecally, via intravitreal injection, or by intravenous infusion over a period of time, on a regular basis. In certain embodiments, after an initial treatment regimen, the treatments can be administered on a less frequent basis. Administration of the RNAi agent can reduce HTT levels, e.g., in a cell, tissue, blood, CSF sample or other compartment of the patient by at least 20%, 30%, 40%, 50%, 55%, 60%, 65%, 70,% 75%, 80%, 85%, 90%, 95%, 96%, 97%, 98%, or at least about 99% or more. In a preferred embodiment, administration of the RNAi agent can reduce HTT levels, e.g., in a cell, tissue, blood, CSF sample or other compartment of the patient by at least 50%.

Before administration of a full dose of the RNAi agent, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the RNAi agent can be administered subcutaneously, i.e., by subcutaneous injection. One or more injections may be used to deliver the desired, e.g., monthly dose of RNAi agent to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of RNAi agent on a regular basis, such as monthly or extending to once a quarter, twice per year, once per year. In certain embodiments, the RNAi agent is administered about once per month to about once per quarter (i.e., about once every three months).

Unless otherwise defined, all technical and scientific terms used herein have the same meaning as commonly understood by one of ordinary skill in the art to which this invention belongs. Although methods and materials similar or equivalent to those described herein can be used in the practice or testing of the RNAi agents and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1. RNAi Agent Design, Synthesis, Selection, and In Vitro Evaluation

This Example describes methods for the design, synthesis, selection, and in vitro evaluation of HTT RNAi agents.

Source of Reagents

Where the source of a reagent is not specifically given herein, such reagent can be obtained from any supplier of reagents for molecular biology at a quality/purity standard for application in molecular biology.

Bioinformatics siRNAs targeting the human huntingtin transcript (HTT; human NCBI refseqID NM_002111.8; NCBI GeneID: 3064) or the mouse HTT transcript (HTT; mouse NCBI refseqID NM_010414.3; NCBI GeneID: 15194) were designed using custom R and Python scripts. The human NM_002111 REFSEQ mRNA, version 8, has a length of 13,498 bases. The mouse NM_010414 REFSEQ mRNA, version 3, has a length of 13,237 bases.

In addition, siRNAs targeting exon 1 of the human huntingtin transcript (HTT; human NCBI refseqID NM_002111.8; NCBI GeneID: 3064) were designed using custom R and Python scripts.

Detailed lists of the unmodified HTT sense and antisense strand nucleotide sequences are shown in Tables 2, 5, 8, 11, 14, 18, 21, 25, 28, 30 and 33. Detailed lists of the modified HTT sense and antisense strand nucleotide sequences are shown in Tables 3, 6, 9, 12, 15, 17, 20, 24, 27, 29 and 32.

It is to be understood that, throughout the application, a duplex name without a decimal is equivalent to a duplex name with a decimal which merely references the batch number of the duplex. For example, AD-564727 is equivalent to AD-564727.1.

Cell Culture and Transfections

Cells were transfected by adding 4.9 μL of Opti-MEM plus 0.1 μL of RNAiMAX per well (Invitrogen, Carlsbad CA cat #13778-150) to 5 μL of siRNA duplexes per well, with 4 replicates of each siRNA duplex, into a 384-well plate, and incubated at room temperature for 15 minutes. Forty μL of MEDIA containing ~$5\times10^3$ cells were then added to the siRNA mixture. Cells were incubated for 24 hours prior to RNA purification. Experiments were performed at 50 nM, 10 nM, 1 nM, and 0.1 nM. Transfection experiments were performed in human neuroblastoma BE(2)C cells (ATCC CRL-2268) with EMEM:F12 media (Gibco catalog no. 11765054).

Cell Culture and 384-Well Transfections

Primary cynomolgus hepatocytes (PCH) freshly isolated less than 1 hour prior to transfections were grown in primary hepatocyte media. HeP3B cells were grown in appropriate media. Transfection was carried out by adding 14.8 μl of Opti-MEM plus 0.2 μl of Lipofectamine RNAiMax per well (Invitrogen, Carlsbad CA cat #13778-150) to 5 μl of each siRNA duplex to an individual well. The mixture was then incubated at room temperature for 15 minutes. Eighty μl of complete growth media without antibiotic containing ~$2\times10^4$ cells were then added to the siRNA mixture. Cells were incubated for 24 hours prior to RNA purification. Single dose experiments in HeP3B were performed at 50 nM, 10 nM, 1 nM, and 0.1 nM final duplex concentration. Single dose experiments in PCH were performed at 50 nM, 10 nM, 1 nM, and 0.1 nM final duplex concentration.

Total RNA Isolation Using DYNABEADS mRNA Isolation Kit

RNA was isolated using an automated protocol on a BioTek-EL406 platform using DYNABEADs (Invitrogen, cat #61012). Briefly, 70 μL of Lysis/Binding Buffer and 10 μL of lysis buffer containing 3 μL of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μL Wash Buffer A and once with Wash Buffer B. Beads were then washed with 150 μL Elution Buffer, re-captured and supernatant removed.

cDNA Synthesis Using ABI High Capacity cDNA Reverse Transcription Kit (Applied Biosystems, Foster City, CA, Cat #4368813)

Ten μL of a master mix containing 1 μL 10× Buffer, 0.4 μL 25× dNTPs, 1 μL 10× Random primers, 0.5 μL Reverse Transcriptase, 0.5 μL RNase inhibitor and 6.6 μL of $H_2O$ per reaction was added to RNA isolated above. Plates were sealed, mixed, and incubated on an electromagnetic shaker for 10 minutes at room temperature, followed by 2 hour incubation at 37° C.

Real Time PCR

Two μL of cDNA were added to a master mix containing 0.5 μL of human or mouse GAPDH TaqMan Probe (ThermoFisher cat 4352934E or 4351309) and 0.5 μL of appropriate HTT probe (commercially available, e.g., from Thermo Fisher) and 5 μL Lightcycler 480 probe master mix (Roche Cat #04887301001) per well in a 384 well plates (Roche cat #04887301001). Real time PCR was done in a LightCycler480 Real Time PCR system (Roche). Each duplex was tested with N=4 and data were normalized to cells transfected with a non-targeting control siRNA. To calculate relative fold change, real time data were analyzed using the ΔΔCt method and normalized to assays performed with cells transfected with a non-targeting control siRNA.

The results of the screening of the dsRNA agents listed in Tables 2 and 3 in BE(2)C cells are provided in Table 4.

The results of the screening of the dsRNA agents listed in Tables 5 and 6 in BE(2)C cells are provided in Table 7.

The results of the screening of the dsRNA agents listed in Tables 8 and 9 in BE(2)C cells are provided in Table 10.

The results of the screening of the dsRNA agents listed in Tables 11 and 12 in BE(2)C cells are provided in Table 13.

The results of the screening of the dsRNA agents listed in Tables 14 and 15 in BE(2)C cells are provided in Table 16.

The results of the screening of the dsRNA agents listed in Tables 17 and 18 in BE(2)C cells are provided in Table 19.

The results of the screening of the dsRNA agents listed in Tables 20 and 21 in HeP3B cells are provided in Table 22.

The results of the screening of the dsRNA agents listed in Tables 20 and 21 in primary cynomolgus hepatocytes (PCH) cells are provided in Table 23.

The results of the screening of the dsRNA agents listed in Tables 24 and 25 in BE(2)C cells are provided in Table 26.

The results of the screening of the dsRNA agents listed in Tables 27 and 28 in BE(2)C cells are provided in Table 34.

The results of the screening of the dsRNA agents listed in Tables 29 and 30 in BE(2)C cells are provided in Table 31.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Ab | beta-L-adenosine-3`-phosphate |
| Abs | beta-L-adenosine-3`-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3`-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3`-phosphate |
| Gbs | beta-L-guanosine-3`-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |

TABLE 1-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol Hyp-(GalNAc-alkyl)3 |
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dA | 2`-deoxyadenosine-3`-phosphate |
| dAs | 2`-deoxyadenosine-3`-phosphorothioate |
| dC | 2`-deoxycytidine-3`-phosphate |
| dCs | 2`-deoxycytidine-3`-phosphorothioate |
| dG | 2`-deoxyguanosine-3`-phosphate |
| dGs | 2`-deoxyguanosine-3`-phosphorothioate |
| dT | 2`-deoxythymidine-3`-phosphate |
| dTs | 2`-deoxythymidine-3`-phosphorothioate |
| dU | 2`-deoxyuridine |
| dUs | 2`-deoxyuridine-3`-phosphorothioate |
| (Ahd) | 2`-O-hexadecyl-adenosine-3'-phosphate |
| (Ahds) | 2'-O-hexadecyl-adenosine-3'-phosphorothioate |
| (Chd) | 2'-O-hexadecyl-cytidine-3'-phosphate |
| (Chds) | 2'-O-hexadecyl-cytidine-3'-phosphorothioate |
| (Ghd) | 2'-O-hexadecyl-guanosine-3'-phosphate |
| (Ghds) | 2'-O-hexadecyl-guanosine-3'-phosphorothioate |
| (Uhd) | 2'-O-hexadecyl-uridine-3'-phosphate |
| (Uhds) | 2'-O-hexadecyl-uridine-3'-phosphorothioate |
| (C2p) | cytidine-2`-phosphate |
| (G2p) | guanosine-2`-phosphate |
| (U2p) | uridine-2`-phosphate |
| (A2p) | adenosine-2`-phosphate |

TABLE 2

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-384118.1 | GGACUAAAACUUUUUAUCAAA | 15 | NM_010414.3_12016-12036_s | 12016-12036 | UUUGAUAAAAAGUUUUAGUCCCU | 216 | NM_010414.3_12014-12036_as | 12014-12036 |
| AD-380543.1 | CUCUGUUACCAGCUACUACAU | 16 | NM_010414.3_7846-7866_G21U_s | 7846-7866 | AUGUAGTAGCUGGUAACAGAGAA | 217 | NM_010414.3_7844-7866_C1A_as | 7844-7866 |
| AD-380533.1 | CCUGUCCCUUCUCUGUUACCA | 17 | NM_010414.3_7836-7856_s | 7836-7856 | UGGUAACAGAGAAGGGACAGGAU | 218 | NM_010414.3_7834-7856_as | 7834-7856 |
| AD-384038.1 | UUUGUGAGUCUAGCAUCUGAU | 18 | NM_010414.3_11916-11936_G21U_s | 11916-11936 | AUCAGAUGCUAGACUCACAAAGC | 219 | NM_010414.3_11914-11936_C1A_as | 11914-11936 |
| AD-380805.1 | GAUCAGUGAAGUGGUUCGAUU | 19 | NM_010414.3_8189-8209_C21U_s | 8189-8209 | AAUCGAACCACUUCACUGAUCAG | 220 | NM_010414.3_8187-8209_G1A_as | 8187-8209 |
| AD-380117.1 | CCUCUGGUAUGGAAACUCGGU | 20 | NM_010414.3_7338-7358_G21U_s | 7338-7358 | ACCGAGTUUCCAUACCAGAGGAG | 221 | NM_010414.3_7336-7358_C1A_as | 7336-7358 |
| AD-381341.1 | AGAGUCCUUGGUCAAGCUAAU | 21 | NM_010414.3_8789-8809_G21U_s | 8789-8809 | AUUAGCTGACCAAGGACUCUGU | 222 | NM_010414.3_8787-8809_C1A_as | 8787-8809 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-379426.1 | UUCAACCUAAGCCUUUUGGCU | 22 | NM_010414.3_6525-6545_s | 6525-6545 | AGCCAAAAGGCUUAGGUUGAACU | 223 | NM_010414.3_6523-6545_as | 6523-6545 |
| AD-380888.1 | UGACAGAACUACGGAGAGUGU | 23 | NM_010414.3_8272-8292_C21U_s | 8272-8292 | ACACUCUCCGUAGUUCUGUCAGC | 224 | NM_010414.3_8270-8292_G1A_as | 8270-8292 |
| AD-384841.1 | CUCCAUGUGUGCUUGUCACAU | 24 | NM_010414.3_12871-12891_C21U_s | 12871-12891 | AUGUGACAAGCACACAUGGAGGG | 225 | NM_010414.3_12869-12891_G1A_as | 12869-12891 |
| AD-380853.1 | CGAACGUACCCAGUUUGAAAU | 25 | NM_010414.3_8237-8257_s | 8237-8257 | AUUUCAAACUGGGUACGUUCGGU | 226 | NM_010414.3_8235-8257_as | 8235-8257 |
| AD-379602.1 | AUACCACAUCAUACCAGUCUU | 26 | NM_010414.3_6739-6759_C21U_s | 6739-6759 | AAGACUGGUAUGAUGUGGUAUCA | 227 | NM_010414.3_6737-6759_G1A_as | 6737-6759 |
| AD-382484.1 | CUGCAUGUGACAAAGUUUAUU | 27 | NM_010414.3_10129-10149_G21U_s | 10129-10149 | AAUAAACUUUGUCACAUGCAGCA | 228 | NM_010414.3_10127-10149_C1A_as | 10127-10149 |
| AD-380741.1 | UUCACUCCUGUUCGCAGUUUC | 28 | NM_010414.3_8104-8124_s | 8104-8124 | GAAACUGCGAACAGGAGUGAAUA | 229 | NM_010414.3_8102-8124_as | 8102-8124 |
| AD-380534.1 | CUGUCCCUUCUCUGUUACCAU | 29 | NM_010414.3_7837-7857_G21U_s | 7837-7857 | AUGGUAACAGAGAAGGGACAGGA | 230 | NM_010414.3_7835-7857_C1A_as | 7835-7857 |
| AD-384053.1 | UCUGAGAAUGGGACUCAAUUU | 30 | NM_010414.3_11931-11951_s | 11931-11951 | AAAUUGAGUCCCAUUCUCAGAUG | 231 | NM_010414.3_11929-11951_as | 11929-11951 |
| AD-380916.1 | UCAGAAGAUGAGAUCCUCAUU | 31 | NM_010414.3_8298-8318_s | 8298-8318 | AAUGAGGAUCUCAUCUUCUGAAG | 232 | NM_010414.3_8296-8318_as | 8296-8318 |
| AD-380402.1 | CCACUGAAGGCUCUCGAUACU | 32 | NM_010414.3_7704-7724_C21U_s | 7704-7724 | AGUAUCGAGAGCCUUCAGUGGCU | 233 | NM_010414.3_7702-7724_G1A_as | 7702-7724 |
| AD-381464.1 | GAGUCUGUGAUUGUAGCUAUU | 33 | NM_010414.3_8946-8966_G21U_s | 8946-8966 | AAUAGCTACAAUCACAGACUCGC | 234 | NM_010414.3_8944-8966_C1A_as | 8944-8966 |
| AD-379729.1 | UCAUGGCAUUUGAUCCAUGAU | 34 | NM_010414.3_6888-6908_G21U_s | 6888-6908 | AUCAUGGAUCAAAUGCCAUGACA | 235 | NM_010414.3_6886-6908_C1A_as | 6886-6908 |
| AD-381065.1 | ACGGCAUCCUCUAUGUGUUGU | 35 | NM_010414.3_8452-8472_G21U_s | 8452-8472 | ACAACACAUAGAGGAUGCCGUGC | 236 | NM_010414.3_8450-8472_C1A_as | 8450-8472 |
| AD-379466.1 | UGAGCGAGAUUGCUAAUGGCU | 36 | NM_010414.3_6565-6585_C21U_s | 6565-6585 | AGCCAUTAGCAAUCUCGCUCAUG | 237 | NM_010414.3_6563-6585_G1A_as | 6563-6585 |
| AD-380885.1 | CGCUGACAGAACUACGGAGAU | 37 | NM_010414.3_8269-8289_G21U_s | 8269-8289 | AUCUCCGUAGUUCUGUCAGCGUC | 238 | NM_010414.3_8267-8289_C1A_as | 8267-8289 |
| AD-379897.1 | AAGCAGGUCACAUACUCCAAU | 38 | NM_010414.3_7097-7117_G21U_s | 7097-7117 | AUUGGAGUAUGUGACCUGCUUUC | 239 | NM_010414.3_7095-7117_C1A_as | 7095-7117 |
| AD-381124.1 | CCAGUUGUUAGUGACUAUCUU | 39 | NM_010414.3_8511-8531_G21U_s | 8511-8531 | AAGAUAGUCACUAACAACUGGAA | 240 | NM_010414.3_8509-8531_C1A_as | 8509-8531 |
| AD-380807.1 | UCAGUGAAGUGGUUCGAUCUU | 40 | NM_010414.3_8191-8211_C21U_s | 8191-8211 | AAGAUCGAACCACUUCACUGAUC | 241 | NM_010414.3_8189-8211_G1A_as | 8189-8211 |
| AD-380806.1 | AUCAGUGAAGUGGUUCGAUCU | 41 | NM_010414.3_8190-8210_s | 8190-8210 | AGAUCGAACCACUUCACUGAUCA | 242 | NM_010414.3_8188-8210_as | 8188-8210 |
| AD-384843.1 | CCAUGUGUGCUUGUCACACUU | 42 | NM_010414.3_12873-12893_C21U_s | 12873-12893 | AAGUGUGACAAGCACACAUGGAG | 243 | NM_010414.3_12871-12893_G1A_as | 12871-12893 |
| AD-381257.1 | UUUCAGCAUCUGUGAUACAGA | 43 | NM_010414.3_8653-8673_s | 8653-8673 | UCUGUAUCACAGAUGCUGAAAAU | 244 | NM_010414.3_8651-8673_as | 8651-8673 |
| AD-380408.1 | AAGGCUCUCGAUACCAGAUUU | 44 | NM_010414.3_7710-7730_s | 7710-7730 | AAAUCUGGUAUCGAGAGCCUUCA | 245 | NM_010414.3_7708-7730_as | 7708-7730 |
| AD-381570.1 | UAGAUGACUUCUUUCCACCUU | 45 | NM_010414.3_9052-9072_C21U_s | 9052-9072 | AAGGUGGAAAGAAGUCAUCUAGG | 246 | NM_010414.3_9050-9072_G1A_as | 9050-9072 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-380093.1 | GUUAACAGCUAUACUCGUGUU | 46 | NM_010414.3_7314-7334_G21U_s | 7314-7334 | AACACGAGUAUAGCUGUUAACUA | 247 | NM_010414.3_7312-7334_C1A_as | 7312-7334 |
| AD-381148.1 | UCCAACCUCAAAGGAAUAGCU | 47 | NM_010414.3_8535-8555_C21U_s | 8535-8555 | AGCUAUTCCUUUGAGGUUGGACA | 248 | NM_010414.3_8533-8555_G1A_as | 8533-8555 |
| AD-379475.1 | UUGCUAAUGGCCAAAAGAGUU | 48 | NM_010414.3_6574-6594_C21U_s | 6574-6594 | AACUCUTUUGGCCAUUAGCAAUC | 249 | NM_010414.3_6572-6594_G1A_as | 6572-6594 |
| AD-381142.1 | CUGCUGUCCAACCUCAAAGGA | 49 | NM_010414.3_8529-8549_s | 8529-8549 | UCCUUUGAGGUUGGACAGCAGAU | 250 | NM_010414.3_8527-8549_as | 8527-8549 |
| AD-380852.1 | CCGAACGUACCCAGUUUGAAA | 50 | NM_010414.3_8236-8256_s | 8236-8256 | UUUCAAACUGGGUACGUUCGGUG | 251 | NM_010414.3_8234-8256_as | 8234-8256 |
| AD-379935.1 | AAGUAGACUCAGAUAUACAAA | 51 | NM_010414.3_7135-7155_s | 7135-7155 | UUUGUAUAUCUGAGUCUACUUCC | 252 | NM_010414.3_7133-7155_as | 7133-7155 |
| AD-381117.1 | GCUCAUUCCAGUUGUUAGUGA | 52 | NM_010414.3_8504-8524_s | 8504-8524 | UCACUAACAACUGGAAUGAGCUG | 253 | NM_010414.3_8502-8524_as | 8502-8524 |
| AD-380808.1 | CAGUGAAGUGGUUCGAUCUCU | 53 | NM_010414.3_8192-8212_s | 8192-8212 | AGAGAUCGAACCACUUCACUGAU | 254 | NM_010414.3_8190-8212_as | 8190-8212 |
| AD-379471.1 | GAGAUUGCUAAUGGCCAAAAU | 54 | NM_010414.3_6570-6590_G21U_s | 6570-6590 | AUUUUGGCCAUUAGCAAUCUCGC | 255 | NM_010414.3_6568-6590_C1A_as | 6568-6590 |
| AD-381342.1 | GAGUCCUUGGUCAAGCUAAGU | 55 | NM_010414.3_8790-8810_s | 8790-8810 | ACUUAGCUUGACCAAGGACUCUG | 256 | NM_010414.3_8788-8810_as | 8788-8810 |
| AD-380411.1 | GCUCUCGAUACCAGAUUUGGA | 56 | NM_010414.3_7713-7733_s | 7713-7733 | UCCAAATCUGGUAUCGAGAGCCU | 257 | NM_010414.3_7711-7733_as | 7711-7733 |
| AD-382487.1 | CAUGUGACAAAGUUUAUGGAA | 57 | NM_010414.3_10132-10152_s | 10132-10152 | UUCCAUAAACUUUGUCACAUGCA | 258 | NM_010414.3_10130-10152_as | 10130-10152 |
| AD-380116.1 | UCCUCUGGUAUGGAAACUCGU | 58 | NM_010414.3_7337-7357_G21U_s | 7337-7357 | ACGAGUTUCCAUACCAGAGGAGG | 259 | NM_010414.3_7335-7357_C1A_as | 7335-7357 |
| AD-381150.1 | CAACCUCAAAGGAAUAGCCCA | 59 | NM_010414.3_8537-8557_s | 8537-8557 | UGGGCUAUUCCUUUGAGGUUGGA | 260 | NM_010414.3_8535-8557_as | 8535-8557 |
| AD-379476.1 | UGCUAAUGGCCAAAAGAGUCU | 60 | NM_010414.3_6575-6595_C21U_s | 6575-6595 | AGACUCUUUUGGCCAUUAGCAAU | 261 | NM_010414.3_6573-6595_G1A_as | 6573-6595 |
| AD-382444.1 | CCUAUGCCCGUGUAAAGUGUU | 61 | NM_010414.3_10089-10109_G21U_s | 10089-10109 | AACACUTUACACGGGCAUAGGAA | 262 | NM_010414.3_10087-10109_C1A_as | 10087-10109 |
| AD-380883.1 | GACGCUGACAGAACUACGGAU | 62 | NM_010414.3_8267-8287_G21U_s | 8267-8287 | AUCCGUAGUUCUGUCAGCGUCAG | 263 | NM_010414.3_8265-8287_C1A_as | 8265-8287 |
| AD-379941.1 | ACUCAGAUAUACAAAACCUCA | 63 | NM_010414.3_7141-7161_s | 7141-7161 | UGAGGUTUUGUAUAUCUGAGUCU | 264 | NM_010414.3_7139-7161_as | 7139-7161 |
| AD-381578.1 | UUCUUUCCACCUCAAGAUGUU | 64 | NM_010414.3_9060-9080_C21U_s | 9060-9080 | AACAUCUUGAGGUGGAAAGAAGU | 265 | NM_010414.3_9058-9080_G1A_as | 9058-9080 |
| AD-381460.1 | CAGCGAGUCUGUGAUUGUAGU | 65 | NM_010414.3_8942-8962_C21U_s | 8942-8962 | ACUACAAUCACAGACUCGCUGUC | 266 | NM_010414.3_8940-8962_G1A_as | 8940-8962 |
| AD-379939.1 | AGACUCAGAUAUACAAAACCU | 66 | NM_010414.3_7139-7159_s | 7139-7159 | AGGUUUTGUAUAUCUGAGUCUAC | 267 | NM_010414.3_7137-7159_as | 7137-7159 |
| AD-384039.1 | UUGUGAGUCUAGCAUCUGAGA | 67 | NM_010414.3_11917-11937_s | 11917-11937 | UCUCAGAUGCUAGACUCACAAAG | 268 | NM_010414.3_11915-11937_as | 11915-11937 |
| AD-380735.1 | UUGAUAUUCACUCCUGUUCGU | 68 | NM_010414.3_8098-8118_C21U_s | 8098-8118 | ACGAACAGGAGUGAAUAUCAACC | 269 | NM_010414.3_8096-8118_G1A_as | 8096-8118 |
| AD-382525.1 | UAGCUACUCAGUCUAGUCGGU | 69 | NM_010414.3_10188-10208_G21U_s | 10188-10208 | ACCGACTAGACUGAGUAGCUACA | 270 | NM_010414.3_10186-10208_C1A_as | 10186-10208 |
| AD-380713.1 | CCUGUGUCUCCAGUCAAUUCU | 70 | NM_010414.3_8058-8078_C21U_s | 8058-8078 | AGAAUUGACUGGAGACACAGGUG | 271 | NM_010414.3_8056-8078_G1A_as | 8056-8078 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-382149.1 | AGGGAACAUGCACUAUGUUGU | 71 | NM_010414.3_9696-9716_G21U_s | 9696-9716 | ACAACAUAGUGCAUGUUCCCUGC | 272 | NM_010414.3_9694-9716_C1A_as | 9694-9716 |
| AD-379855.1 | AGCCAUUGCAGUACAACCUGU | 72 | NM_010414.3_7055-7075_G21U_s | 7055-7075 | ACAGGUUGUACUGCAAUGGCUUC | 273 | NM_010414.3_7053-7075_C1A_as | 7053-7075 |
| AD-383508.1 | UGCAAGGUUCCCUACCAAACA | 73 | NM_010414.3_11251-11271_s | 11251-11271 | UGUUUGGUAGGGAACCUUGCAUC | 274 | NM_010414.3_11249-11271_as | 11249-11271 |
| AD-381273.1 | ACAGAUGUGUGGAGUAAUGCU | 74 | NM_010414.3_8669-8689_s | 8669-8689 | AGCAUUACUCCACACAUCUGUAU | 275 | NM_010414.3_8667-8689_as | 8667-8689 |
| AD-382483.1 | GCUGCAUGUGACAAAGUUUAU | 75 | NM_010414.3_10128-10148_s | 10128-10148 | AUAAACUUUGUCACAUGCAGCAC | 276 | NM_010414.3_10126-10148_as | 10126-10148 |
| AD-382481.1 | GUGCUGCAUGUGACAAAGUUU | 76 | NM_010414.3_10126-10146_s | 10126-10146 | AAACUUUGUCACAUGCAGCACAG | 277 | NM_010414.3_10124-10146_as | 10124-10146 |
| AD-382485.1 | UGCAUGUGACAAAGUUUAUGU | 77 | NM_010414.3_10130-10150_G21U_s | 10130-10150 | ACAUAAACUUUGUCACAUGCAGC | 278 | NM_010414.3_10128-10150_C1A_as | 10128-10150 |
| AD-380092.1 | AGUUAACAGCUAUACUCGUGU | 78 | NM_010414.3_7313-7333_s | 7313-7333 | ACACGAGUAUAGCUGUUAACUAG | 279 | NM_010414.3_7311-7333_as | 7311-7333 |
| AD-379420.1 | GCUCGGAGUUCAACCUAAGCU | 79 | NM_010414.3_6517-6537_C21U_s | 6517-6537 | AGCUUAGGUUGAACUCCGAGCUC | 280 | NM_010414.3_6515-6537_G1A_as | 6515-6537 |
| AD-380800.1 | AUCCUGAUCAGUGAAGUGGUU | 80 | NM_010414.3_8184-8204_s | 8184-8204 | AACCACUUCACUGAUCAGGAUGA | 281 | NM_010414.3_8182-8204_as | 8182-8204 |
| AD-384030.1 | CAGUCAGCUUUGUGAGUCUAU | 81 | NM_010414.3_11908-11928_G21U_s | 11908-11928 | AUAGACUCACAAAGCUGACUGUA | 282 | NM_010414.3_11906-11928_C1A_as | 11906-11928 |
| AD-380737.1 | GAUAUUCACUCCUGUUCGCAU | 82 | NM_010414.3_8100-8120_G21U_s | 8100-8120 | AUGCGAACAGGAGUGAAUAUCAA | 283 | NM_010414.3_8098-8120_C1A_as | 8098-8120 |
| AD-382780.1 | UUGAUGCACUCUCCUAGUCUU | 83 | NM_010414.3_10463-10483_C21U_s | 10463-10483 | AAGACUAGGAGAGUGCAUCAACA | 284 | NM_010414.3_10461-10483_G1A_as | 10461-10483 |
| AD-379944.1 | CAGAUAUACAAAACCUCAGUU | 84 | NM_010414.3_7144-7164_C21U_s | 7144-7164 | AACUGAGGUUUUGUAUAUCUGAG | 285 | NM_010414.3_7142-7164_G1A_as | 7142-7164 |
| AD-379461.1 | UGGCAUGAGCGAGAUUGCUAA | 85 | NM_010414.3_6560-6580_s | 6560-6580 | UUAGCAAUCUCGCUCAUGCCAAG | 286 | NM_010414.3_6558-6580_as | 6558-6580 |
| AD-381856.1 | ACAGGUGGAUGUGAACCUUUU | 86 | NM_010414.3_9353-9373_s | 9353-9373 | AAAAGGUUCACAUCCACCUGUUC | 287 | NM_010414.3_9351-9373_as | 9351-9373 |
| AD-379418.1 | GAGCUCGGAGUUCAACCUAAU | 87 | NM_010414.3_6515-6535_G21U_s | 6515-6535 | AUUAGGUUGAACUCCGAGCUCAU | 288 | NM_010414.3_6513-6535_C1A_as | 6513-6535 |
| AD-382924.1 | UGUCCCUUUGUAUCUUCUGCA | 88 | NM_010414.3_10607-10627_s | 10607-10627 | UGCAGAAGAUACAAAGGGACAGA | 289 | NM_010414.3_10605-10627_as | 10605-10627 |
| AD-383759.1 | ACUCCUCAUGGUAGAUGUUCA | 89 | NM_010414.3_11578-11598_s | 11578-11598 | UGAACAUCUACCAUGAGGAGUAA | 290 | NM_010414.3_11576-11598_as | 11576-11598 |
| AD-380409.1 | AGGCUCUCGAUACCAGAUUUG | 90 | NM_010414.3_7711-7731_s | 7711-7731 | CAAAUCUGGUAUCGAGAGCCUUC | 291 | NM_010414.3_7709-7731_as | 7709-7731 |
| AD-379380.1 | CUCGGAGUUCAACCUAAGCCU | 91 | NM_002111.8_6562-6582_s | 6562-6582 | AGGCUUAGGUUGAACUCCGAGCU | 292 | NM_010414.3_6516-6538_as | 6562-6582 |
| AD-381145.1 | CUGUCCAACCUCAAAGGAAUA | 92 | NM_010414.3_8532-8552_s | 8532-8552 | UAUUCCUUUGAGGUUGGACAGCA | 293 | NM_010414.3_8530-8552_as | 8530-8552 |
| AD-384054.1 | CUGAGAAUGGGACUCAAUUUU | 93 | NM_010414.3_11932-11952_s | 11932-11952 | AAAAUUGAGUCCCAUUCUCAGAU | 294 | NM_010414.3_11930-11952_as | 11930-11952 |
| AD-380796.1 | CGUCAUCCUGAUCAGUGAAGU | 94 | NM_010414.3_8180-8200_s | 8180-8200 | ACUUCACUGAUCAGGAUGACGGG | 295 | NM_010414.3_8178-8200_as | 8178-8200 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-382960.1 | CAAAGGUGUCUCUGAGCUAUU | 95 | NM_010414.3_10663-10683_G21U_s | 10663-10683 | AAUAGCTCAGAGACACCUUUGGG | 296 | NM_010414.3_10661-10683_C1A_as | 10661-10683 |
| AD-380555.1 | CUACUACAGGUGCUCUUAUCA | 96 | NM_010414.3_7858-7878_s | 7858-7878 | UGAUAAGAGCACCUGUAGUAGCU | 297 | NM_010414.3_7856-7878_as | 7856-7878 |
| AD-379462.1 | GGCAUGAGCGAGAUUGCUAAU | 97 | NM_010414.3_6561-6581_s | 6561-6581 | AUUAGCAAUCUCGCUCAUGCCAA | 298 | NM_010414.3_6559-6581_as | 6559-6581 |
| AD-382118.1 | UGGCAGGAGUGCUUUGCAAUU | 98 | NM_010414.3_9665-9685_G21U_s | 9665-9685 | AAUUGCAAAGCACUCCUGCCAUU | 299 | NM_010414.3_9663-9685_C1A_as | 9663-9685 |
| AD-380414.1 | CUCGAUACCAGAUUUGGAAGA | 99 | NM_010414.3_7716-7736_s | 7716-7736 | UCUUCCAAAUCUGGUAUCGAGAG | 300 | NM_010414.3_7714-7736_as | 7714-7736 |
| AD-380091.1 | UAGUUAACAGCUAUACUCGUU | 100 | NM_010414.3_7312-7332_G21U_s | 7312-7332 | AACGAGTAUAGCUGUUAACUAGG | 301 | NM_010414.3_7310-7332_C1A_as | 7310-7332 |
| AD-383761.1 | UCCUCAUGGUAGAUGUUCAUA | 101 | NM_010414.3_11580-11600_s | 11580-11600 | UAUGAACAUCUACCAUGAGGAGU | 302 | NM_010414.3_11578-11600_as | 11578-11600 |
| AD-380740.1 | AUUCACUCCUGUUCGCAGUUU | 102 | NM_010414.3_8103-8123_s | 8103-8123 | AAACUGCGAACAGGAGUGAAUAU | 303 | NM_010414.3_8101-8123_as | 8101-8123 |
| AD-379945.1 | AGAUAUACAAAACCUCAGUCA | 103 | NM_010414.3_7145-7165_s | 7145-7165 | UGACUGAGGUUUUGUAUAUCUGA | 304 | NM_010414.3_7143-7165_as | 7143-7165 |
| AD-379425.1 | GUUCAACCUAAGCCUUUUGGU | 104 | NM_010414.3_6524-6544_C21U_s | 6524-6544 | ACCAAAAGGCUUAGGUUGAACUC | 305 | NM_010414.3_6522-6544_G1A_as | 6522-6544 |
| AD-380886.1 | GCUGACAGAACUACGGAGAGU | 105 | NM_010414.3_8270-8290_s | 8270-8290 | ACUCUCCGUAGUUCUGUCAGCGU | 306 | NM_010414.3_8268-8290_as | 8268-8290 |
| AD-384366.1 | CUGCACAUGUACCCUUCAGGA | 106 | NM_010414.3_12307-12327_s | 12307-12327 | UCCUGAAGGGUACAUGUGCAGAC | 307 | NM_010414.3_12305-12327_as | 12305-12327 |
| AD-380798.1 | UCAUCCUGAUCAGUGAAGUGU | 107 | NM_010414.3_8182-8202_G21U_s | 8182-8202 | ACACUUCACUGAUCAGGAUGACG | 308 | NM_010414.3_8180-8202_C1A_as | 8180-8202 |
| AD-379463.1 | GCAUGAGCGAGAUUGCUAAUU | 108 | NM_010414.3_6562-6582_G21U_s | 6562-6582 | AAUUAGCAAUCUCGCUCAUGCCA | 309 | NM_010414.3_6560-6582_C1A_as | 6560-6582 |
| AD-382148.1 | CAGGGAACAUGCACUAUGUUU | 109 | NM_010414.3_9695-9715_G21U_s | 9695-9715 | AAACAUAGUGCAUGUUCCCUGCA | 310 | NM_010414.3_9693-9715_C1A_as | 9693-9715 |
| AD-357754.1 | UUGUUCUUUCUCGUAUUCAGU | 110 | NM_002111.8_5223-5243_G21U_s | 5223-5243 | ACUGAATACGAGAAAGAACAAUA | 311 | NM_002111.8_5221-5243_C1A_as | 5221-5243 |
| AD-356938.1 | UGCAGAUAAGAAUGCUAUUCA | 111 | NM_002111.8_4387-4407_s | 4387-4407 | UGAAUAGCAUUCUUAUCUGCACG | 312 | NM_002111.8_4385-4407_as | 4385-4407 |
| AD-355054.1 | CAAACUCUAUAAAGUUCCUCU | 112 | NM_002111.8_2347-2367_s | 2347-2367 | AGAGGAACUUUAUAGAGUUUGCU | 313 | NM_002111.8_2345-2367_as | 2345-2367 |
| AD-357748.1 | AAGAUAUUGUUCUUUCUCGUA | 113 | NM_002111.8_5217-5237_s | 5217-5237 | UACGAGAAAGAACAAUAUCUUCA | 314 | NM_002111.8_5215-5237_as | 5215-5237 |
| AD-355704.1 | CUGAAACUUCUCAUGCAUGAU | 114 | NM_002111.8_3035-3055_G21U_s | 3035-3055 | AUCAUGCAUGAGAAGUUUCAGGU | 315 | NM_002111.8_3033-3055_C1A_as | 3033-3055 |
| AD-356946.1 | AGAAUGCUAUUCAUAAUCACA | 115 | NM_002111.8_4395-4415_s | 4395-4415 | UGUGAUTAUGAAUAGCAUUCUUA | 316 | NM_002111.8_4393-4415_as | 4393-4415 |
| AD-353499.1 | UCAACAAAGUUAUCAAAGCUU | 116 | NM_002111.8_603-623_s | 603-623 | AAGCUUTGAUAACUUUGUUGAGG | 317 | NM_002111.8_601-623_as | 601-623 |
| AD-354076.1 | GAACUGACGUUACAUCAUACA | 117 | NM_002111.8_1226-1246_s | 1226-1246 | UGUAUGAUGUAACGUCAGUUCAU | 318 | NM_002111.8_1224-1246_as | 1224-1246 |
| AD-356630.1 | CCUGAAAUCCUGCUUUAGUCU | 118 | NM_002111.8_4039-4059_G21U_s | 4039-4059 | AGACUAAAGCAGGAUUUCAGGUA | 319 | NM_002111.8_4037-4059_C1A_as | 4037-4059 |
| AD-353351.1 | CAUUGUCUGACAAUAUGUGAA | 119 | NM_002111.8_455-475_s | 455-475 | UUCACATAUUGUCAGACAAUGAU | 320 | NM_002111.8_453-475_as | 453-475 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-359803.1 | CAGUCGUACUCAGUUUGAAGA | 120 | NM_002111.8_7528-7548_s | 7528-7548 | UCUUCAAACUGAGUACGACUGGU | 321 | NM_002111.8_7526-7548_as | 7526-7548 |
| AD-382526.1 | AGCUACUCAGUCUAGUCGGGU | 121 | NM_010414.3_10189-10209_C21U_s | 10189-10209 | ACCCGACUAGACUGAGUAGCUAC | 322 | NM_010414.3_10187-10209_G1A_as | 10187-10209 |
| AD-356975.1 | UUUGAACCUCUUGUUAUAAAA | 122 | NM_002111.8_4424-4444_s | 4424-4444 | UUUUAUAACAAGAGGUUCAAACA | 323 | NM_002111.8_4422-4444_as | 4422-4444 |
| AD-356974.1 | GUUUGAACCUCUUGUUAUAAA | 123 | NM_002111.8_4423-4443_s | 4423-4443 | UUUAUAACAAGAGGUUCAAACAA | 324 | NM_002111.8_4421-4443_as | 4421-4443 |
| AD-355117.1 | CUUGAACUACAUCGAUCAUGU | 124 | NM_002111.8_2410-2430_G21U_s | 2410-2430 | ACAUGAUCGAUGUAGUUCAAGAU | 325 | NM_002111.8_2408-2430_C1A_as | 2408-2430 |
| AD-357755.1 | UGUUCUUUCUCGUAUUCAGGA | 125 | NM_002111.8_5224-5244_s | 5224-5244 | UCCUGAAUACGAGAAAGAACAAU | 326 | NM_002111.8_5222-5244_as | 5222-5244 |
| AD-356382.1 | GCAGCUUCUAGACAAUCUGAU | 126 | NM_002111.8_3773-3793_s | 3773-3793 | AUCAGAUUGUCUAGAAGCUGCAC | 327 | NM_002111.8_3771-3793_as | 3771-3793 |
| AD-356973.1 | UGUUUGAACCUCUUGUUAUAA | 127 | NM_002111.8_4422-4442_s | 4422-4442 | UUAUAACAAGAGGUUCAAACAAA | 328 | NM_002111.8_4420-4442_as | 4420-4442 |
| AD-358488.1 | GAAAACCUUUCAACUCCAACU | 128 | NM_002111.8_6035-6055_C21U_s | 6035-6055 | AGUUGGAGUUGAAAGGUUUUCAC | 329 | NM_002111.8_6033-6055_G1A_as | 6033-6055 |
| AD-354078.1 | ACUGACGUUACAUCAUACACA | 129 | NM_002111.8_1228-1248_s | 1228-1248 | UGUGUAUGAUGUAACGUCAGUUC | 330 | NM_002111.8_1226-1248_as | 1226-1248 |
| AD-356638.1 | CCUGCUUUAGUCGAGAACCAA | 130 | NM_002111.8_4047-4067_s | 4047-4067 | UUGGUUCUCGACUAAAGCAGGAU | 331 | NM_002111.8_4045-4067_as | 4045-4067 |
| AD-357096.1 | UGGAUUCAGAUCAGGUGUUUA | 131 | NM_002111.8_4545-4565_s | 4545-4565 | UAAACACCUGAUCUGAAUCCAGA | 332 | NM_002111.8_4543-4565_as | 4543-4565 |
| AD-361492.1 | CUGCUGACUUGUUUACGAAAU | 132 | NM_002111.8_9536-9556_s | 9536-9556 | AUUUCGUAAACAAGUCAGCAGCC | 333 | NM_002111.8_9534-9556_as | 9534-9556 |
| AD-382775.1 | UGGUGUUGAUGCACUCUCCUA | 133 | NM_010414.3_10458-10478_s | 10458-10478 | UAGGAGAGUGCAUCAACACCAGG | 334 | NM_010414.3_10456-10478_as | 10456-10478 |
| AD-357239.1 | CAGAUCAUUGGAAUUCCUAAA | 134 | NM_002111.8_4688-4708_s | 4688-4708 | UUUAGGAAUUCCAAUGAUCUGUU | 335 | NM_002111.8_4686-4708_as | 4686-4708 |
| AD-357756.1 | GUUCUUUCUCGUAUUCAGGAU | 135 | NM_002111.8_5225-5245_G21U_s | 5225-5245 | AUCCUGAAUACGAGAAAGAACAA | 336 | NM_002111.8_5223-5245_C1A_as | 5223-5245 |
| AD-356384.1 | AGCUUCUAGACAAUCUGAUAU | 136 | NM_002111.8_3775-3795_C21U_s | 3775-3795 | AUAUCAGAUUGUCUAGAAGCUGC | 337 | NM_002111.8_3773-3795_G1A_as | 3773-3795 |
| AD-357879.1 | AUUUUCAAGGUUUCUAUUACA | 137 | NM_002111.8_5368-5388_s | 5368-5388 | UGUAAUAGAAACCUUGAAAAUGU | 338 | NM_002111.8_5366-5388_as | 5366-5388 |
| AD-356386.1 | CUUCUAGACAAUCUGAUACCU | 138 | NM_002111.8_3777-3797_s | 3777-3797 | AGGUAUCAGAUUGUCUAGAAGCU | 339 | NM_002111.8_3775-3797_as | 3775-3797 |
| AD-356995.1 | AGCUUUAAAACAGUACACGAU | 139 | NM_002111.8_4444-4464_C21U_s | 4444-4464 | AUCGUGUACUGUUUUAAAGCUUU | 340 | NM_002111.8_4442-4464_G1A_as | 4442-4464 |
| AD-353516.1 | GCUUUGAUGGAUUCUAAUCUU | 140 | NM_002111.8_620-640_s | 620-640 | AAGAUUAGAAUCCAUCAAAGCUU | 341 | NM_002111.8_618-640_as | 618-640 |
| AD-354079.1 | CUGACGUUACAUCAUACACAU | 141 | NM_002111.8_1229-1249_G21U_s | 1229-1249 | AUGUGUAUGAUGUAACGUCAGUU | 342 | NM_002111.8_1227-1249_C1A_as | 1227-1249 |
| AD-356639.1 | CUGCUUUAGUCGAGAACCAAU | 142 | NM_002111.8_4048-4068_s | 4048-4068 | AUUGGUTCUCGACUAAAGCAGGA | 343 | NM_002111.8_4046-4068_as | 4046-4068 |
| AD-357649.1 | UGUUCGUCACUCCAAACACAA | 143 | NM_002111.8_5118-5138_s | 5118-5138 | UUGUGUTUGGAGUGACGAACAUA | 344 | NM_002111.8_5116-5138_as | 5116-5138 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-361496.1 | UGACUUGUUUACGAAAUGUCU | 144 | NM_002111.8_9540-9560_C21U_s | 9540-9560 | AGACAUUCGUAAACAAGUCAGC | 345 | NM_002111.8_9538-9560_G1A_as | 9538-9560 |
| AD-382777.1 | GUGUUGAUGCACUCUCCUAGU | 145 | NM_010414.3_10460-10480_s | 10460-10480 | ACUAGGAGAGUGCAUCAACACCA | 346 | NM_010414.3_10458-10480_as | 10458-10480 |
| AD-353525.1 | GAUUCUAAUCUUCCAAGGUUA | 146 | NM_002111.8_629-649_s | 629-649 | UAACCUUGGAAGAUUAGAAUCCA | 347 | NM_002111.8_627-649_as | 627-649 |
| AD-358480.1 | CUCGUUGUGAAAACCUUUCAA | 147 | NM_002111.8_6027-6047_s | 6027-6047 | UUGAAAGGUUUUCACAACGAGAC | 348 | NM_002111.8_6025-6047_as | 6025-6047 |
| AD-356388.1 | UCUAGACAAUCUGAUACCUCA | 148 | NM_002111.8_3779-3799_s | 3779-3799 | UGAGGUAUCAGAUUGUCUAGAAG | 349 | NM_002111.8_3777-3799_as | 3777-3799 |
| AD-353500.1 | CAACAAAGUUAUCAAAGCUUU | 149 | NM_002111.8_604-624_s | 604-624 | AAAGCUUGAUAACUUUGUUGAG | 350 | NM_002111.8_602-624_as | 602-624 |
| AD-356407.1 | CAGGUCCUGUUACAACAAGUA | 150 | NM_002111.8_3798-3818_s | 3798-3818 | UACUUGUUGUAACAGGACCUGAG | 351 | NM_002111.8_3796-3818_as | 3796-3818 |
| AD-357068.1 | GUUCAGUUACGGGUUAAUUAU | 151 | NM_002111.8_4517-4537_C21U_s | 4517-4537 | AUAAUUAACCCGUAACUGAACCA | 352 | NM_002111.8_4515-4537_G1A_as | 4515-4537 |
| AD-359802.1 | CCAGUCGUACUCAGUUUGAAU | 152 | NM_002111.8_7527-7547_G21U_s | 7527-7547 | AUUCAAACUGAGUACGACUGGUC | 353 | NM_002111.8_7525-7547_C1A_as | 7525-7547 |
| AD-354638.1 | UCUGAAAUUGUGUUAGACGGU | 153 | NM_002111.8_1886-1906_s | 1886-1906 | ACCGUCTAACACAAUUUCAGAAC | 354 | NM_002111.8_1884-1906_as | 1884-1906 |
| AD-356663.1 | GGCAACUGUUUGUGUUCAACA | 154 | NM_002111.8_4072-4092_s | 4072-4092 | UGUUGAACACAAACAGUUGCCAU | 355 | NM_002111.8_4070-4092_as | 4070-4092 |
| AD-357651.1 | UUCGUCACUCCAAACACAAUU | 155 | NM_002111.8_5120-5140_G21U_s | 5120-5140 | AAUUGUGUUUGGAGUGACGAACA | 356 | NM_002111.8_5118-5140_C1A_as | 5118-5140 |
| AD-362085.1 | CUGACAUUUCCGUUGUACAUU | 156 | NM_002111.8_10314-10334_G21U_s | 10314-10334 | AAUGUACAACGGAAAUGUCAGCG | 357 | NM_002111.8_10312-10334_C1A_as | 10312-10334 |
| AD-384329.1 | CCACUGCCAAGUGCCCUUUAU | 157 | NM_010414.3_12270-12290_s | 12270-12290 | AUAAAGGGCACUUGGCAGUGGCU | 358 | NM_010414.3_12268-12290_as | 12268-12290 |
| AD-354067.1 | CAGGUUUAUGAACUGACGUUA | 158 | NM_002111.8_1217-1237_s | 1217-1237 | UAACGUCAGUUCAUAAACCUGGA | 359 | NM_002111.8_1215-1237_as | 1215-1237 |
| AD-353526.1 | AUUCUAAUCUUCCAAGGUUAU | 159 | NM_002111.8_630-650_C21U_s | 630-650 | AUAACCUGGAAGAUUAGAAUCC | 360 | NM_002111.8_628-650_G1A_as | 628-650 |
| AD-356422.1 | CAAGUAAAUCCUCAUCACUGU | 160 | NM_002111.8_3813-3833_G21U_s | 3813-3833 | ACAGUGAUGAGGAUUUACUUGUU | 361 | NM_002111.8_3811-3833_C1A_as | 3811-3833 |
| AD-353519.1 | UUGAUGGAUUCUAAUCUUCCA | 161 | NM_002111.8_623-643_s | 623-643 | UGGAAGAUUAGAAUCCAUCAAAG | 362 | NM_002111.8_621-643_as | 621-643 |
| AD-356443.1 | CUUCAUACCUCAAACUGCAUU | 162 | NM_002111.8_3852-3872_G21U_s | 3852-3872 | AAUGCAGUUUGAGGUAUGAAGGA | 363 | NM_002111.8_3850-3872_C1A_as | 3850-3872 |
| AD-357115.1 | UAUUGGCUUUGUAUUGAAACA | 163 | NM_002111.8_4564-4584_s | 4564-4584 | UGUUUCAAUACAAAGCCAAUAAA | 364 | NM_002111.8_4562-4584_as | 4562-4584 |
| AD-361493.1 | UGCUGACUUGUUUACGAAAUU | 164 | NM_002111.8_9537-9557_G21U_s | 9537-9557 | AAUUUCGUAAACAAGUCAGCAGC | 365 | NM_002111.8_9535-9557_C1A_as | 9535-9557 |
| AD-354639.1 | CUGAAAUUGUGUUAGACGGUA | 165 | NM_002111.8_1887-1907_s | 1887-1907 | UACCGUCUAACACAAUUUCAGAA | 366 | NM_002111.8_1885-1907_as | 1885-1907 |
| AD-356955.1 | UUCAUAAUCACAUUCGUUUGU | 166 | NM_002111.8_4404-4424_s | 4404-4424 | ACAAACGAAUGUGAUUAUGAAUA | 367 | NM_002111.8_4402-4424_as | 4402-4424 |
| AD-358471.1 | CAAUUCAGUCUCGUUGUGAAA | 167 | NM_002111.8_6018-6038_s | 6018-6038 | UUUCACAACGAGACUGAAUUGCC | 368 | NM_002111.8_6016-6038_as | 6016-6038 |
| AD-354066.1 | CCAGGUUUAUGAACUGACGUU | 168 | NM_002111.8_1216-1236_s | 1216-1236 | AACGUCAGUUCAUAAACCUGGAC | 369 | NM_002111.8_1214-1236_as | 1214-1236 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | | Source and Range | Range |
|---|---|---|---|---|---|---|---|---|
| AD-384665.1 | CCUCCAGGGAUUGGUAUGUGU | 169 | NM_010414.3_12695-12715_G21U_s | 12695-12715 | ACACAUACCAAUCCCUGGAGGAC | 370 | NM_010414.3_12693-12715_C1A_as | 12693-12715 |
| AD-355045.1 | UUUCUUCAGCAAACUCUAUAA | 170 | NM_002111.8_2338-2358_s | 2338-2358 | UUAUAGAGUUUGCUGAAGAAAGA | 371 | NM_002111.8_2336-2358_as | 2336-2358 |
| AD-353715.1 | UGUUCCCAAAAUUAUGGCUUU | 171 | NM_002111.8_844-864_C21U_s | 844-864 | AAAGCCAUAAUUUUGGGAACAGC | 372 | NM_002111.8_842-864_G1A_as | 842-864 |
| AD-356429.1 | UUUCUAUCAUCUUCCUUCAUA | 172 | NM_002111.8_3838-3858_s | 3838-3858 | UAUGAAGGAAGAUGAUAGAAACU | 373 | NM_002111.8_3836-3858_as | 3836-3858 |
| AD-359761.1 | CUUUAAGGAGUUCAUCUACCU | 173 | NM_002111.8_7486-7506_G21U_s | 7486-7506 | AGGUAGAUGAACUCCUUAAAGAC | 374 | NM_002111.8_7484-7506_C1A_as | 7484-7506 |
| AD-356669.1 | UGUUUGUGUUCAACAAUUGUU | 174 | NM_002111.8_4078-4098_s | 4078-4098 | AACAAUTGUUGAACACAAACAGU | 375 | NM_002111.8_4076-4098_as | 4076-4098 |
| AD-357684.1 | ACUGUUCAACUGUGGAUAUCU | 175 | NM_002111.8_5153-5173_G21U_s | 5153-5173 | AGAUAUCCACAGUUGAACAGUGC | 376 | NM_002111.8_5151-5173_C1A_as | 5151-5173 |
| AD-361981.1 | UAACGUAACUCUUUCUAUGCU | 176 | NM_002111.8_10173-10193_C21U_s | 10173-10193 | AGCAUAGAAAGAGUUACGUUAAA | 377 | NM_002111.8_10171-10193_G1A_as | 10171-10193 |
| AD-355423.1 | UCUGAGGAACAGUUCCUAUUU | 177 | NM_002111.8_2716-2736_G21U_s | 2716-2736 | AAAUAGGAACUGUUCCUCAGAGU | 378 | NM_002111.8_2714-2736_C1A_as | 2714-2736 |
| AD-356956.1 | UCAUAAUCACAUUCGUUUGUU | 178 | NM_002111.8_4405-4425_s | 4405-4425 | AACAAACGAAUGUGAUUAUGAAU | 379 | NM_002111.8_4403-4425_as | 4403-4425 |
| AD-353522.1 | AUGGAUUCUAAUCUUCCAAGU | 179 | NM_002111.8_626-646_G21U_s | 626-646 | ACUUGGAAGAUUAGAAUCCAUCA | 380 | NM_002111.8_624-646_C1A_as | 624-646 |
| AD-354075.1 | UGAACUGACGUUACAUCAUAU | 180 | NM_002111.8_1225-1245_C21U_s | 1225-1245 | AUAUGAUGUAACGUCAGUUCAUA | 381 | NM_002111.8_1223-1245_G1A_as | 1223-1245 |
| AD-355059.1 | UCUAUAAAGUUCCUCUUGACA | 181 | NM_002111.8_2352-2372_s | 2352-2372 | UGUCAAGAGGAACUUUAUAGAGU | 382 | NM_002111.8_2350-2372_as | 2350-2372 |
| AD-356951.1 | GCUAUUCAUAAUCACAUUCGU | 182 | NM_002111.8_4400-4420_s | 4400-4420 | ACGAAUGUGAUUAUGAAUAGCAU | 383 | NM_002111.8_4398-4420_as | 4398-4420 |
| AD-353871.1 | GCUACUAAAUGUGCUCUUAGU | 183 | NM_002111.8_1021-1041_G21U_s | 1021-1041 | ACUAAGAGCACAUUUAGUAGCCA | 384 | NM_002111.8_1019-1041_C1A_as | 1019-1041 |
| AD-356996.1 | GCUUUAAAACAGUACACGACU | 184 | NM_002111.8_4445-4465_s | 4445-4465 | AGUCGUGUACUGUUUUAAAGCUU | 385 | NM_002111.8_4443-4465_as | 4443-4465 |
| AD-354068.1 | AGGUUUAUGAACUGACGUUAU | 185 | NM_002111.8_1218-1238_C21U_s | 1218-1238 | AUAACGTCAGUUCAUAAACCUGG | 386 | NM_002111.8_1216-1238_G1A_as | 1216-1238 |
| AD-356678.1 | UCAACAAUUGUUGAAGACUCU | 186 | NM_002111.8_4087-4107_s | 4087-4107 | AGAGUCTCAACAAUUGUUGAAC | 387 | NM_002111.8_4085-4107_as | 4085-4107 |
| AD-357963.1 | GCAACAUACUUUCUAUUGCCA | 187 | NM_002111.8_5452-5472_s | 5452-5472 | UGGCAATAGAAAGUAUGUUGCUG | 388 | NM_002111.8_5450-5472_as | 5450-5472 |
| AD-362090.1 | AUUUCCGUUGUACAUGUUCCU | 188 | NM_002111.8_10319-10339_s | 10319-10339 | AGGAACAUGUACAACGGAAAUGU | 389 | NM_002111.8_10317-10339_as | 10317-10339 |
| AD-355745.1 | CUCCGUCAGCACAAUAACCAU | 189 | NM_002111.8_3076-3096_G21U_s | 3076-3096 | AUGGUUAUUGUGCUGACGGAGAA | 390 | NM_002111.8_3074-3096_C1A_as | 3074-3096 |
| AD-357066.1 | UGGUUCAGUUACGGGUUAAUU | 190 | NM_002111.8_4515-4535_s | 4515-4535 | AAUUAACCCGUAACUGAACCAGC | 391 | NM_002111.8_4513-4535_as | 4513-4535 |
| AD-353527.1 | UUCUAAUCUUCCAAGGUUACA | 191 | NM_002111.8_631-651_s | 631-651 | UGUAACCUUGGAAGAUUAGAAUC | 392 | NM_002111.8_629-651_as | 629-651 |
| AD-354236.1 | GAGUAUUGUGGAACUUAUAGU | 192 | NM_002111.8_1405-1425_C21U_s | 1405-1425 | ACUAUAAGUUCCACAAUACUCCC | 393 | NM_002111.8_1403-1425_G1A_as | 1403-1425 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-357750.1 | GAUAUUGUUCUUUCUCGUAUU | 193 | NM_002111.8_5219-5239_s | 5219-5239 | AAUACGAGAAAGAACAAUAUCUU | 394 | NM_002111.8_5217-5239_as | 5217-5239 |
| AD-356389.1 | CUAGACAAUCUGAUACCUCAU | 194 | NM_002111.8_3780-3800_G21U_s | 3780-3800 | AUGAGGTAUCAGAUUGUCUAGAA | 395 | NM_002111.8_3778-3800_C1A_as | 3778-3800 |
| AD-354939.1 | CGCCUUUUAUCUGCUUCGUUU | 195 | NM_002111.8_2207-2227_s | 2207-2227 | AAACGAAGCAGAUAAAAGGCGGA | 396 | NM_002111.8_2205-2227_as | 2205-2227 |
| AD-357218.1 | UAUGAACGCUAUCAUUCAAAA | 196 | NM_002111.8_4667-4687_s | 4667-4687 | UUUUGAAUGAUAGCGUUCAUAAG | 397 | NM_002111.8_4665-4687_as | 4665-4687 |
| AD-354640.1 | UGAAAUUGUGUUAGACGGUAU | 197 | NM_002111.8_1888-1908_C21U_s | 1888-1908 | AUACCGTCUAACACAAUUUCAGA | 398 | NM_002111.8_1886-1908_G1A_as | 1886-1908 |
| AD-358018.1 | AUCUUCAAGUCUGGAAUGUUU | 198 | NM_002111.8_5507-5527_C21U_s | 5507-5527 | AAACAUTCCAGACUUGAAGAUGU | 399 | NM_002111.8_5505-5527_G1A_as | 5505-5527 |
| AD-362093.1 | UCCGUUGUACAUGUUCCUGUU | 199 | NM_002111.8_10322-10342_s | 10322-10342 | AACAGGAACAUGUACAACGGAAA | 400 | NM_002111.8_10320-10342_as | 10320-10342 |
| AD-356385.1 | GCUUCUAGACAAUCUGAUACU | 200 | NM_002111.8_3776-3796_C21U_s | 3776-3796 | AGUAUCAGAUUGUCUAGAAGCUG | 401 | NM_002111.8_3774-3796_G1A_as | 3774-3796 |
| AD-357069.1 | UUCAGUUACGGGUUAAUUACU | 201 | NM_002111.8_4518-4538_s | 4518-4538 | AGUAAUTAACCCGUAACUGAACC | 402 | NM_002111.8_4516-4538_as | 4516-4538 |
| AD-358764.1 | CAUGCAAGACUCACUUAGUCU | 202 | NM_002111.8_6349-6369_C21U_s | 6349-6369 | AGACUAAGUGAGUCUUGCAUGGU | 403 | NM_002111.8_6347-6369_G1A_as | 6347-6369 |
| AD-354316.1 | GAUGACUCUGAAUCGAGAUCU | 203 | NM_002111.8_1508-1528_G21U_s | 1508-1528 | AGAUCUCGAUUCAGAGUCAUCCU | 404 | NM_002111.8_1506-1528_C1A_as | 1506-1528 |
| AD-355775.1 | AGGCUAUAACCUACUACCAAU | 204 | NM_002111.8_3106-3126_G21U_s | 3106-3126 | AUUGGUAGUAGGUUAUAGCCUCU | 405 | NM_002111.8_3104-3126_C1A_as | 3104-3126 |
| AD-354320.1 | ACUCUGAAUCGAGAUCGGAUU | 205 | NM_002111.8_1512-1532_G21U_s | 1512-1532 | AAUCCGAUCUCGAUUCAGAGUCA | 406 | NM_002111.8_1510-1532_C1A_as | 1510-1532 |
| AD-355783.1 | ACCUACUACCAAGCAUAACAU | 206 | NM_002111.8_3114-3134_G21U_s | 3114-3134 | AUGUUATGCUUGGUAGUAGGUUA | 407 | NM_002111.8_3112-3134_C1A_as | 3112-3134 |
| AD-354322.1 | UCUGAAUCGAGAUCGGAUGUU | 207 | NM_002111.8_1514-1534_C21U_s | 1514-1534 | AACAUCCGAUCUCGAUUCAGAGU | 408 | NM_002111.8_1512-1534_G1A_as | 1512-1534 |
| AD-356408.1 | AGGUCCUGUUACAACAAGUAA | 208 | NM_002111.8_3799-3819_s | 3799-3819 | UUACUUGUUGUAACAGGACCUGA | 409 | NM_002111.8_3797-3819_as | 3797-3819 |
| AD-354805.1 | ACAGCAGUGUUGAUAAAUUUG | 209 | NM_002111.8_2073-2093_s | 2073-2093 | CAAAUUTAUCAACACUGCUGUCA | 410 | NM_002111.8_2071-2093_as | 2071-2093 |
| AD-356409.1 | GGUCCUGUUACAACAAGUAAA | 210 | NM_002111.8_3800-3820_s | 3800-3820 | UUUACUTGUUGUAACAGGACCUG | 411 | NM_002111.8_3798-3820_as | 3798-3820 |
| AD-355118.1 | UUGAACUACAUCGAUCAUGGA | 211 | NM_002111.8_2411-2431_s | 2411-2431 | UCCAUGAUCGAUGUAGUUCAAGA | 412 | NM_002111.8_2409-2431_as | 2409-2431 |
| AD-358958.1 | ACUCGGAGUUCAACCUAAGCU | 212 | NM_002111.8_6561-6581_C21U_s | 6561-6581 | AGCUUAGGUUGAACUCCGAGUUC | 413 | NM_002111.8_6559-6581_G1A_as | 6559-6581 |
| AD-355422.1 | CUCUGAGGAACAGUUCCUAUU | 213 | NM_002111.8_2715-2735_s | 2715-2735 | AAUAGGAACUGUUCCUCAGAGUC | 414 | NM_002111.8_2713-2735_as | 2713-2735 |
| AD-358959.1 | CUCGGAGUUCAACCUAAGCCU | 91 | NM_002111.8_6562-6582_s | 6562-6582 | AGGCUUAGGUUGAACUCCGAGUU | 415 | NM_002111.8_6560-6582_as | 6560-6582 |
| AD-355424.1 | CUGAGGAACAGUUCCUAUUGU | 214 | NM_002111.8_2717-2737_G21U_s | 2717-2737 | ACAAUAGGAACUGUUCCUCAGAG | 416 | NM_002111.8_2715-2737_C1A_as | 2715-2737 |
| AD-379420.2 | GCUCGGAGUUCAACCUAAGCU | 79 | NM_010414.3_6517-6537_C21U_s | 6517-6537 | AGCUUAGGUUGAACUCCGAGCUC | 280 | NM_010414.3_6515-6537_G1A_as | 6515-6537 |
| AD-355524.1 | AUCAUUAUACAGGGCUUUUAA | 215 | NM_002111.8_2835-2855_s | 2835-2855 | UUAAAAGCCCUGUAUAAUGAUGA | 417 | NM_002111.8_2833-2855_as | 2833-2855 |

TABLE 2-continued

Unmodified Sense and Antisense Strand Sequences of Huntingtin (HTT) dsRNA Agents

| Duplex Name | Sense Sequence 5' to 3' | SEQ ID NO: | Source and Range | Range | Antisense Sequence 5' to 3' | SEQ ID NO: | Source and Range | Range |
|---|---|---|---|---|---|---|---|---|
| AD-379380.2 | CUCGGAGUUCAACCUAAGCCU | 91 | NM_002111.8_6562-6582_s | 6562-6582 | AGGCUUAGGUUGAACUCCGAGCU | 292 | NM_010414.3_6516-6538_as | 6562-6582 |

TABLE 3

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-384118.1 | gsgsacuaAfaAfCfUfuuuuaucaaaL96 | 418 | usUfsugau(Agn)aaaaguUfuUfaguccscsu | 619 | AGGGACUAAAACUUUUUAUCAAA | 821 |
| AD-380543.1 | csuscuguUfaCfCfAfgcuacuacauL96 | 419 | asUfsguag(Tgn)agcuggUfaAfcagagsasa | 620 | UUCUCUGUUACCAGCUACUACAG | 822 |
| AD-380533.1 | cscsugucCfcUfUfCfucuguuaccaL96 | 420 | usGfsguaa(Cgn)agagaaGfgGfacaggsasu | 621 | AUCCUGUCCCUUCUCUGUUACCA | 823 |
| AD-384038.1 | ususugugAfgUfCfUfagcaucugauL96 | 421 | asUfscaga(Tgn)gcuagaCfuCfacaaasgsc | 622 | GCUUUGUGAGUCUAGCAUCUGAG | 824 |
| AD-380805.1 | gsasucagUfgAfAfGfugguucgauuL96 | 422 | asAfsucga(Agn)ccacuuCfaCfugaucsasg | 623 | CUGAUCAGUGAAGUGGUUCGAUC | 825 |
| AD-380117.1 | cscsucugGfuAfUfGfgaaacucgguL96 | 423 | asCfscgag(Tgn)uuccauAfcCfagaggsasg | 624 | CUCCUCUGGUAUGGAAACUCGGG | 826 |
| AD-381341.1 | asgsagucCfuUfGfGfucaagcuaauL96 | 424 | asUfsuagc(Tgn)ugaccaAfgGfacucusgsu | 625 | ACAGAGUCCUUGGUCAAGCUAAG | 827 |
| AD-379426.1 | ususcaacCfuAfAfGfccuuuggcuL96 | 425 | asGfsccaa(Agn)aggcuuAfgGfuugaascsu | 626 | AGUUCAACCUAAGCCUUUGGCU | 828 |
| AD-380888.1 | usgsacagAfaCfUfAfcggagaguguL96 | 426 | asCfsacuc(Tgn)ccguagUfuCfugucasgsc | 627 | GCUGACAGAACUACGGAGAGUGC | 829 |
| AD-384841.1 | csusccauGfuGfUfGfcuugucacauL96 | 427 | asUfsguga(Cgn)aagcacAfcAfuggagsgsg | 628 | CCCUCCAUGUGUGCUUGUCACAC | 830 |
| AD-380853.1 | csgsaacgUfaCfCfCfaguuugaaauL96 | 428 | asUfsuuca(Agn)acugggUfaCfgucgsgsu | 629 | ACCGAACGUACCCAGUUUGAAAU | 831 |
| AD-379602.1 | asusaccaCfaUfCfAfuaccagucuuL96 | 429 | asAfsgacu(Ggn)guaugaUfgUfgguauscsa | 630 | UGAUACCACAUCAUACCAGUCUC | 832 |
| AD-382484.1 | csusgcauGfuGfAfCfaaaguuuauuL96 | 430 | asAfsuaaa(Cgn)uuugucAfcAfugcagscsa | 631 | UGCUGCAUGUGACAAAGUUUAUG | 833 |
| AD-380741.1 | ususcacuCfcUfGfUfucgcaguuucL96 | 431 | gsAfsaacu(Ggn)cgaacaGfgAfgugaasusa | 632 | UAUUCACUCCUGUUCGCAGUUUC | 834 |
| AD-380534.1 | csusguccCfuUfCfUfcuguuaccauL96 | 432 | asUfsggua(Agn)cagagaAfgGfgacagsgsa | 633 | UCCUGUCCCUUCUCUGUUACCAG | 835 |
| AD-384053.1 | uscsugagAfaUfGfGfgacucaauuuL96 | 433 | asAfsauug(Agn)guccaUfuCfucagasusg | 634 | CAUCUGAGAAUGGGACUCAAUUU | 836 |
| AD-380916.1 | uscsagaaGfaUfGfAfgauccucauuL96 | 434 | asAfsugag(Ggn)aucucaUfcUfucugasasg | 635 | CUUCAGAAGAUGAGAUCCUCAUU | 837 |
| AD-380402.1 | cscsacugAfaGfGfCfucucgauacuL96 | 435 | asGfsuauc(Ggn)agagccUfuCfaguggscsu | 636 | AGCCACUGAAGGCUCUCGAUACC | 838 |
| AD-381464.1 | gsasgucuGfuGfAfUfuguagcuauuL96 | 436 | asAfsuagc(Tgn)acaaucAfcAfgacucsgsc | 637 | GCGAGUCUGUGAUUGUAGCUAUG | 839 |
| AD-379729.1 | uscsauggCfaUfUfUfgauccaugauL96 | 437 | asUfscaug(Ggn)aucaaaUfgCfcaugascsa | 638 | UGUCAUGGCAUUUGAUCCAUGAG | 840 |
| AD-381065.1 | ascsggcaUfcCfUfCfuauguguuguL96 | 438 | asCfsaaca(Cgn)auagagGfaUfgccgusgsc | 639 | GCACGGCAUCCUCUAUGUGUUGG | 841 |
| AD-379466.1 | usgsagcgAfgAfUfUfgcuaauggcuL96 | 439 | asGfsccau(Tgn)agcaauCfuCfgcucasusg | 640 | CAUGAGCGAGAUUGCUAAUGGCC | 842 |
| AD-380885.1 | csgscugaCfaGfAfAfcuacggagauL96 | 440 | asUfscucc(Ggn)uaguucUfgUfcagcgsusc | 641 | GACGCUGACAGAACUACGGAGAG | 843 |

TABLE 3-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-379897.1 | asasgcagGfuCfAfCfauacuccaauL96 | 441 | asUfsugga(Ggn)uaugugAfcCfugcuusuc | 642 | GAAAGCAGGUCACAUACUCCAAG | 844 |
| AD-381124.1 | cscsaguuGfuUfAfGfugacuaucuuL96 | 442 | asAfsgaua(Ggn)ucacuaAfcAfacuggsasa | 643 | UUCCAGUUGUUAGUGACUAUCUG | 845 |
| AD-380807.1 | uscsagugAfaGfUfGfguucgaucuuL96 | 443 | asAfsgauc(Ggn)aaccacUfuCfacugasusc | 644 | GAUCAGUGAAGUGGUUCGAUCUC | 846 |
| AD-380806.1 | asuscaguGfaAfGfUfgguucgaucuL96 | 444 | asGfsaucg(Agn)accacuUfcAfcugauscsa | 645 | UGAUCAGUGAAGUGGUUCGAUCU | 847 |
| AD-384843.1 | cscsauguGfuGfCfUfugucacacuuL96 | 445 | asAfsgugu(Ggn)acaagcAfcAfcauggsasg | 646 | CUCCAUGUGUGCUUGUCACACUC | 848 |
| AD-381257.1 | ususucagCfaUfCfUfgugauacagaL96 | 446 | usCfsugua(Tgn)cacagaUfgCfugaaasasu | 647 | AUUUUCAGCAUCUGUGAUACAGA | 849 |
| AD-380408.1 | asasggcuCfuCfGfAfuaccagauuuL96 | 447 | asAfsaucu(Ggn)guaucgAfgAfgccuuscsa | 648 | UGAAGGCUCUCGAUACCAGAUUU | 850 |
| AD-381570.1 | usasgaugAfcUfUfCfuuuccaccuuL96 | 448 | asAfsggug(Ggn)aaagaaGfuCfaucuasgsg | 649 | CCUAGAUGACUUCUUUCCACCUC | 851 |
| AD-380093.1 | gsusuaacAfgCfUfAfuacucguguuL96 | 449 | asAfscacg(Agn)guauagCfuGfuuaacsusa | 650 | UAGUUAACAGCUAUACUCGUGUG | 852 |
| AD-381148.1 | uscscaacCfuCfAfAfaggaauagcuL96 | 450 | asGfscuau(Tgn)ccuuugAfgGfuuggascsa | 651 | UGUCCAACCUCAAAGGAAUAGCC | 853 |
| AD-379475.1 | ususgcuaAfuGfGfCfcaaaagaguuL96 | 451 | asAfscucu(Tgn)uuggccAfuUfagcaasusc | 652 | GAUUGCUAAUGGCCAAAAGAGUC | 854 |
| AD-381142.1 | csusgcugUfcCfAfAfccucaaaggaL96 | 452 | usCfscuuu(Ggn)agguugGfaCfagcagsasu | 653 | AUCUGCUGUCCAACCUCAAAGGA | 855 |
| AD-380852.1 | cscsgaacGfuAfCfCfcaguuugaaaL96 | 453 | usUfsucaa(Agn)cuggguAfcGfuucggsusg | 654 | CACCGAACGUACCCAGUUUGAAA | 856 |
| AD-379935.1 | asasguagAfcUfCfAfgauauacaaaL96 | 454 | usUfsugua(Tgn)aucugaGfuCfuacuuscsc | 655 | GGAAGUAGACUCAGAUAUACAAA | 857 |
| AD-381117.1 | gscsucauUfcCfAfGfuuguuagugaL96 | 455 | usCfsacua(Agn)caacugGfaAfugagcsusg | 656 | CAGCUCAUUCCAGUUGUUAGUGA | 858 |
| AD-380808.1 | csasgugaAfgUfGfGfuucgaucucuL96 | 456 | asGfsagau(Cgn)gaaccaCfuUfcacugsasu | 657 | AUCAGUGAAGUGGUUCGAUCUCU | 859 |
| AD-379471.1 | gsasgauuGfcUfAfAfuggccaaaauL96 | 457 | asUfsuuug(Ggn)ccauuaGfcAfaucucsgsc | 658 | GCGAGAUUGCUAAUGGCCAAAAG | 860 |
| AD-381342.1 | gsasguccUfuGfGfUfcaagcuaaguL96 | 458 | asCfsuuag(Cgn)uugaccAfaGfgacucsusg | 659 | CAGAGUCCUUGGUCAAGCUAAGU | 861 |
| AD-380411.1 | gscsucucGfaUfAfCfcagauuuggaL96 | 459 | usCfscaaa(Tgn)cugguaUfcGfagagcscsu | 660 | AGGCUCUCGAUACCAGAUUUGGA | 862 |
| AD-382487.1 | csasugugAfcAfAfAfguuuauggaaL96 | 460 | usUfsccau(Agn)aacuuuGfuCfacaugscsa | 661 | UGCAUGUGACAAAGUUUAUGGAA | 863 |
| AD-380116.1 | uscscucuGfgUfAfUfggaaacucguL96 | 461 | asCfsgagu(Tgn)uccauaCfcAfgaggasgsg | 662 | CCUCCUCUGGUAUGGAAACUCGG | 864 |
| AD-381150.1 | csasaccuCfaAfAfGfgaauagcccaL96 | 462 | usGfsggcu(Agn)uuccuuUfgAfgguugsgsa | 663 | UCCAACCUCAAAGGAAUAGCCCA | 865 |
| AD-379476.1 | usgscuaaUfgGfCfCfaaaagagucuL96 | 463 | asGfsacuc(Tgn)uuuggcCfaUfuagcasasu | 664 | AUUGCUAAUGGCCAAAAGAGUCC | 866 |
| AD-382444.1 | cscsuaugCfcCfGfUfguaaaguguuL96 | 464 | asAfscacu(Tgn)uacacgGfgCfauaggsasa | 665 | UUCCUAUGCCCGUGUAAAGUGUG | 867 |
| AD-380883.1 | gsascgcuGfaCfAfGfaacuacggauL96 | 465 | asUfsccgu(Agn)guucugUfcAfgcgucsasg | 666 | CUGACGCUGACAGAACUACGGAG | 868 |
| AD-379941.1 | ascsucagAfuAfUfAfcaaaaccucaL96 | 466 | usGfsaggu(Tgn)uuguauAfuCfugaguscsu | 667 | AGACUCAGAUAUACAAAACCUCA | 869 |
| AD-381578.1 | ususcuuuCfcAfCfCfucaagauguuL96 | 467 | asAfscauc(Tgn)ugagguGfgAfaagaasgsu | 668 | ACUUCUUUCCACCUCAAGAUGUC | 870 |
| AD-381460.1 | csasgcgaGfuCfUfGfugauuguaguL96 | 468 | asCfsuaca(Agn)ucacagAfcUfcgcugsusc | 669 | GACAGCGAGUCUGUGAUUGUAGC | 871 |
| AD-379939.1 | asgsacucAfgAfUfAfuacaaaaccuL96 | 469 | asGfsguuu(Tgn)guauauCfuGfagucusasc | 670 | GUAGACUCAGAUAUACAAAACCU | 872 |

TABLE 3-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-384039.1 | ususgugaGfuCfUfAfgcaucugagaL96 | 470 | usCfsucag(Agn)ugcuagAfcUfcacaasasg | 671 | CUUUGUGAGUCUAGCAUCUGAGA | 873 |
| AD-380735.1 | ususgauaUfuCfAfCfuccuguucguL96 | 471 | asCfsgaac(Agn)ggagugAfaUfaucaascsc | 672 | GGUUGAUAUUCACUCCUGUUCGC | 874 |
| AD-382525.1 | usasgcuaCfuCfAfGfucuagucgguL96 | 472 | asCfscgac(Tgn)agacugAfgUfagcuascsa | 673 | UGUAGCUACUCAGUCUAGUCGGG | 875 |
| AD-380713.1 | cscsugugUfcUfCfCfagucaauucuL96 | 473 | asGfsaauu(Ggn)acuggaGfaCfacaggsusg | 674 | CACCUGUGUCUCCAGUCAAUUCC | 876 |
| AD-382149.1 | asgsggaaCfaUfGfCfacuauguuguL96 | 474 | asCfsaaca(Tgn)agugcaUfgUfucccusgsc | 675 | GCAGGGAACAUGCACUAUGUUGG | 877 |
| AD-379855.1 | asgsccauUfgCfAfGfuacaaccuguL96 | 475 | asCfsaggu(Tgn)guacugCfaAfuggcususc | 676 | GAAGCCAUUGCAGUACAACCUGG | 878 |
| AD-383508.1 | usgscaagGfuUfCfCfcuaccaaacaL96 | 476 | usGfsuuug(Ggn)uagggaAfcCfuugcasusc | 677 | GAUGCAAGGUUCCCUACCAAACA | 879 |
| AD-381273.1 | ascsagauGfuGfUfGfgaguaaugcuL96 | 477 | asGfscauu(Agn)cuccacAfcAfucugusasu | 678 | AUACAGAUGUGUGGAGUAAUGCU | 880 |
| AD-382483.1 | gscsugcaUfgUfGfAfcaaaguuuauL96 | 478 | asUfsaaac(Tgn)uugucaCfaUfgcagcsasc | 679 | GUGCUGCAUGUGACAAAGUUUAU | 881 |
| AD-382481.1 | gsusgcugCfaUfGfUfgacaaaguuuL96 | 479 | asAfsacuu(Tgn)gucacaUfgCfagcacsasg | 680 | CUGUGCUGCAUGUGACAAAGUUU | 882 |
| AD-382485.1 | usgscaugUfgAfCfAfaaguuuauguL96 | 480 | asCfsauaa(Agn)cuuuguCfaCfaugcasgsc | 681 | GCUGCAUGUGACAAAGUUUAUGG | 883 |
| AD-380092.1 | asgsuuaaCfaGfCfUfauacucguguL96 | 481 | asCfsacga(Ggn)uauagcUfgUfuaacusasg | 682 | CUAGUUAACAGCUAUACUCGUGU | 884 |
| AD-379420.1 | gscsucggAfgUfUfCfaaccuaagcuL96 | 482 | asGfscuua(Ggn)guugaaCfuCfcgagcsusc | 683 | GAGCUCGGAGUUCAACCUAAGCC | 885 |
| AD-380800.1 | asusccugAfuCfAfGfugaagugguuL96 | 483 | asAfsccac(Tgn)ucacugAfuCfaggausgsa | 684 | UCAUCCUGAUCAGUGAAGUGGUU | 886 |

TABLE 3-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-384030.1 | csasgucaGfcUfUfUfgugagucuauL96 | 484 | asUfsagac(Tgn)cacaaaGfcUfgacugsusa | 685 | UACAGUCAGCUUUGUGAGUCUAG | 887 |
| AD-380737.1 | gsasuauuCfaCfUfCfcuguucgcauL96 | 485 | asUfsgcga(Agn)caggagUfgAfauaucsasa | 686 | UUGAUAUUCACUCCUGUUCGCAG | 888 |
| AD-382780.1 | ususgaugCfaCfUfCfuccuagucuuL96 | 486 | asAfsgacu(Agn)ggagagUfgCfaucaascsa | 687 | UGUUGAUGCACUCUCCUAGUCUC | 889 |
| AD-379944.1 | csasgauaUfaCfAfAfaaccucaguuL96 | 487 | asAfscuga(Ggn)guuuugUfaUfaucugsasg | 688 | CUCAGAUAUACAAAACCUCAGUC | 890 |
| AD-379461.1 | usgsgcauGfaGfCfGfagauugcuaaL96 | 488 | usUfsagca(Agn)ucucgcUfcAfugccasasg | 689 | CUUGGCAUGAGCGAGAUUGCUAA | 891 |
| AD-381856.1 | ascsagguGfgAfUfGfugaaccuuuuL96 | 489 | asAfsaagg(Tgn)ucacauCfcAfccugususc | 690 | GAACAGGUGGAUGUGAACCUUUU | 892 |
| AD-379418.1 | gsasgcucGfgAfGfUfucaaccuaauL96 | 490 | asUfsuagg(Tgn)ugaacuCfcGfagcucsasu | 691 | AUGAGCUCGGAGUUCAACCUAAG | 893 |
| AD-382924.1 | usgsucccUfuUfGfUfaucuucugcaL96 | 491 | usGfscaga(Agn)gauacaAfaGfggacasgsa | 692 | UCUGUCCCUUUGUAUCUUCUGCA | 894 |
| AD-383759.1 | ascsuccuCfaUfGfGfuagauguucaL96 | 492 | usGfsaaca(Tgn)cuaccaUfgAfggagusasa | 693 | UUACUCCUCAUGGUAGAUGUUCA | 895 |
| AD-380409.1 | asgsgcucUfcGfAfUfaccagauuugL96 | 493 | csAfsaauc(Tgn)gguaucGfaGfagccususc | 694 | GAAGGCUCUCGAUACCAGAUUUG | 896 |
| AD-379380.1 | csuscggaGfuUfCfAfaccuaagccuL96 | 494 | asGfsgcuu(Agn)gguugaAfcUfccgagscsu | 695 | CAAAUCUGGUAUCGAGAGCCUUC | 897 |
| AD-381145.1 | csusguccAfaCfCfUfcaaaggaauaL96 | 495 | usAfsuucc(Tgn)uugaggUfuGfgacagcsca | 696 | UGCUGUCCAACCUCAAAGGAAUA | 898 |
| AD-384054.1 | csusgagaAfuGfGfGfacucaauuuuL96 | 496 | asAfsaauu(Ggn)agucccAfuUfcucagsasu | 697 | AUCUGAGAAUGGGACUCAAUUUU | 899 |
| AD-380796.1 | csgsucauCfcUfGfAfucagugaaguL96 | 497 | asCfsuuca(Cgn)ugaucaGfgAfugacgsgsg | 698 | CCCGUCAUCCUGAUCAGUGAAGU | 900 |

TABLE 3-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-382960.1 | csasaaggUfgUfCfUfcugagcuauuL96 | 498 | asAfsuagc(Tgn)cagagaCfaCfcuuugsgsg | 699 | CCCAAAGGUGUCUCUGAGCUAUG | 901 |
| AD-380555.1 | csusacuaCfaGfGfUfgcucuuaucaL96 | 499 | usGfsauaa(Ggn)agcaccUfgUfaguagscsu | 700 | AGCUACUACAGGUGCUCUUAUCA | 902 |
| AD-379462.1 | gsgscaugAfgCfGfAfgauugcuaauL96 | 500 | asUfsuagc(Agn)aucucgCfuCfaugccsasa | 701 | UUGGCAUGAGCGAGAUUGCUAAU | 903 |
| AD-382118.1 | usgsgcagGfaGfUfGfcuuugcaauuL96 | 501 | asAfsuugc(Agn)aagcacUfcCfugccasusu | 702 | AAUGGCAGGAGUGCUUUGCAAUG | 904 |
| AD-380414.1 | csuscgauAfcCfAfGfauuuggaagaL96 | 502 | usCfsuucc(Agn)aaucugGfuAfucgagsasg | 703 | CUCUCGAUACCAGAUUUGGAAGA | 905 |
| AD-380091.1 | usasguuaAfcAfGfCfuauacucguuL96 | 503 | asAfscgag(Tgn)auagcuGfuUfaacuasgsg | 704 | CCUAGUUAACAGCUAUACUCGUG | 906 |
| AD-383761.1 | uscscucaUfgGfUfAfgauguucauaL96 | 504 | usAfsugaa(Cgn)aucuacCfaUfgaggasgsu | 705 | ACUCCUCAUGGUAGAUGUUCAUA | 907 |
| AD-380740.1 | asusucacUfcCfUfGfuucgcaguuuL96 | 505 | asAfsacug(Cgn)gaacagGfaGfugaausasu | 706 | AUAUUCACUCCUGUUCGCAGUUU | 908 |
| AD-379945.1 | asgsauauAfcAfAfAfaccucagucaL96 | 506 | usGfsacug(Agn)gguuuuGfuAfuaucusgsa | 707 | UCAGAUAUACAAAACCUCAGUCA | 909 |
| AD-379425.1 | gsusucaaCfcUfAfAfgccuuuugguL96 | 507 | asCfscaaa(Agn)ggcuuaGfgUfugaacsusc | 708 | GAGUUCAACCUAAGCCUUUUGGC | 910 |
| AD-380886.1 | gscsugacAfgAfAfCfuacggagaguL96 | 508 | asCfsucuc(Cgn)guaguuCfuGfucagcsgsu | 709 | ACGCUGACAGAACUACGGAGAGU | 911 |
| AD-384366.1 | csusgcacAfuGfUfAfcccuucaggaL96 | 509 | usCfscuga(Agn)ggguacAfuGfugcagsasc | 710 | GUCUGCACAUGUACCCUUCAGGA | 912 |
| AD-380798.1 | uscsauccUfgAfUfCfagugaaguguL96 | 510 | asCfsacuu(Cgn)acugauCfaGfgaugascsg | 711 | CGUCAUCCUGAUCAGUGAAGUGG | 913 |
| AD-379463.1 | gscsaugaGfcGfAfGfauugcuaauuL96 | 511 | asAfsuuag(Cgn)aaucucGfcUfcaugcscsa | 712 | UGGCAUGAGCGAGAUUGCUAAUG | 914 |
| AD-382148.1 | csasgggaAfcAfUfGfcacuauguuuL96 | 512 | asAfsacau(Agn)gugcauGfuUfcccugscsa | 713 | UGCAGGGAACAUGCACUAUGUUG | 915 |
| AD-357754.1 | ususguucUfuUfCfUfcguauucaguL96 | 513 | asCfsugaa(Tgn)acgagaAfaGfaacaasusa | 714 | UAUUGUUCUUUCUCGUAUUCAGG | 916 |
| AD-356938.1 | usgscagaUfaAfGfAfaugcuauucaL96 | 514 | usGfsaaua(Ggn)cauucuUfaUfcugcascsg | 715 | CGUGCAGAUAAGAAUGCUAUUCA | 917 |
| AD-355054.1 | csasaacuCfuAfUfAfaaguuccucuL96 | 515 | asGfsagga(Agn)cuuuauAfgAfguuugscsu | 716 | AGCAAACUCUAUAAAGUUCCUCU | 918 |
| AD-357748.1 | asasgauaUfuGfUfUfcuuucucguaL96 | 516 | usAfscgag(Agn)aagaacAfaUfaucuuscsa | 717 | UGAAGAUAUUGUUCUUUCUCGUA | 919 |
| AD-355704.1 | csusgaaaCfuUfCfUfcaugcaugauL96 | 517 | asUfscaug(Cgn)augagaAfgUfuucagsgsu | 718 | ACCUGAAACUUCUCAUGCAUGAG | 920 |
| AD-356946.1 | asgsaaugCfuAfUfUfcauaaucacaL96 | 518 | usGfsugau(Tgn)augaauAfgCfauucusasa | 719 | UAAGAAUGCUAUUCAUAAUCACA | 921 |
| AD-353499.1 | uscsaacaAfaGfUfUfaucaaagcuuL96 | 519 | asAfsgcuu(Tgn)gauaacUfuUfguugasgsg | 720 | CCUCAACAAAGUUAUCAAAGCUU | 922 |
| AD-354076.1 | gsasacugAfcGfUfUfacaucauacaL96 | 520 | usGfsuaug(Agn)uguaacGfuCfaguucsasu | 721 | AUGAACUGACGUUACAUCAUACA | 923 |
| AD-356630.1 | cscsugaaAfuCfCfUfgcuuuagucuL96 | 521 | asGfsacua(Agn)agcaggAfuUfucaggsusa | 722 | UACCUGAAAUCCUGCUUUAGUCG | 924 |
| AD-353351.1 | csasuuguCfuGfAfCfaauaugugaaL96 | 522 | usUfscaca(Tgn)auugucAfgAfcaaugsasu | 723 | AUCAUUGUCUGACAAUAUGUGAA | 925 |
| AD-359803.1 | csasgucgUfaCfUfCfaguuugaagaL96 | 523 | usCfsuuca(Agn)acugagUfaCfgacugsgsu | 724 | ACCAGUCGUACUCAGUUUGAAGA | 926 |
| AD-382526.1 | asgscuacUfcAfGfUfcuagucggguL96 | 524 | asCfsccga(Cgn)uagacuGfaGfuagcusasc | 725 | GUAGCUACUCAGUCUAGUCGGGC | 927 |
| AD-356975.1 | ususugaaCfcUfCfUfuguuauaaaaL96 | 525 | usUfsuuau(Agn)acaagaGfgUfucaaascsa | 726 | UGUUUGAACCUCUUGUUAUAAAA | 928 |

TABLE 3-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-356974.1 | gsusuugaAfcCfUfCfuuguuauaaaL96 | 526 | usUfsuaua(Agn)caagagGfuUfcaaacsasa | 727 | UUGUUUGAACCUCUUGUUAUAAA | 929 |
| AD-355117.1 | csusugaaCfuAfCfAfucgaucauguL96 | 527 | asCfsauga(Tgn)cgauguAfgUfucaagsasu | 728 | AUCUUGAACUACAUCGAUCAUGG | 930 |
| AD-357755.1 | usgsuucuUfuCfUfCfguauucaggaL96 | 528 | usCfscuga(Agn)uacgagAfaAfgaacasasu | 729 | AUUGUUCUUUCUCGUAUUCAGGA | 931 |
| AD-356382.1 | gscsagcuUfcUfAfGfacaaucugauL96 | 529 | asUfscaga(Tgn)ugucuaGfaAfgcugcsasc | 730 | GUGCAGCUUCUAGACAAUCUGAU | 932 |
| AD-356973.1 | usgsuuugAfaCfCfUfcuuguuauaaL96 | 530 | usUfsauaa(Cgn)aagaggUfuCfaaacasasa | 731 | UUUGUUUGAACCUCUUGUUAUAA | 933 |
| AD-358488.1 | gsasaaacCfuUfUfCfaacuccaacuL96 | 531 | asGfsuugg(Agn)guugaaAfgGfuuuucsasc | 732 | GUGAAAACCUUUCAACUCCAACC | 934 |
| AD-354078.1 | ascsugacGfuUfAfCfaucauacacaL96 | 532 | usGfsugua(Tgn)gauguaAfcGfucagususc | 733 | GAACUGACGUUACAUCAUACACA | 935 |
| AD-356638.1 | cscsugcuUfuAfGfUfcgagaaccaaL96 | 533 | usUfsgguu(Cgn)ucgacuAfaAfgcaggsasu | 734 | AUCCUGCUUUAGUCGAGAACCAA | 936 |
| AD-357096.1 | usgsgauuCfaGfAfUfcagguguuuaL96 | 534 | usAfsaaca(Cgn)cugaucUfgAfauccasgsa | 735 | UCUGGAUUCAGAUCAGGUGUUUA | 937 |
| AD-361492.1 | csusgcugAfcUfUfGfuuuacgaaauL96 | 535 | asUfsuucg(Tgn)aaacaaGfuCfagcagscsc | 736 | GGCUGCUGACUUGUUUACGAAAU | 938 |
| AD-382775.1 | usgsguguUfgAfUfGfcacucuccuaL96 | 536 | usAfsggag(Agn)gugcauCfaAfcaccasgsg | 737 | CCUGGUGUUGAUGCACUCUCCUA | 939 |
| AD-357239.1 | csasgaucAfuUfGfGfaauuccuaaaL96 | 537 | usUfsuagg(Agn)auuccaAfuGfaucugsusu | 738 | AACAGAUCAUUGGAAUUCCUAAA | 940 |
| AD-357756.1 | gsusucuuUfcUfCfGfuauucaggauL96 | 538 | asUfsccug(Agn)auacgaGfaAfagaacsasa | 739 | UUGUUCUUUCUCGUAUUCAGGAG | 941 |
| AD-356384.1 | asgscuucUfaGfAfCfaaucugauauL96 | 539 | asUfsauca(Ggn)auugucUfaGfaagcusgsc | 740 | GCAGCUUCUAGACAAUCUGAUAC | 942 |
| AD-357879.1 | asusuuucAfaGfGfUfuucuauuacaL96 | 540 | usGfsuaau(Agn)gaaaccUfuGfaaaausgsu | 741 | ACAUUUUCAAGGUUUCUAUUACA | 943 |
| AD-356386.1 | csusucuaGfaCfAfAfucugauaccuL96 | 541 | asGfsguau(Cgn)agauugUfcUfagaagscsu | 742 | AGCUUCUAGACAAUCUGAUACCU | 944 |
| AD-356995.1 | asgscuuuAfaAfAfCfaguacacgauL96 | 542 | asUfscgug(Tgn)acuguuUfuAfaagcususu | 743 | AAAGCUUUAAAACAGUACACGAC | 945 |
| AD-353516.1 | gscsuuugAfuGfGfAfuucuaaucuuL96 | 543 | asAfsgauu(Agn)gaauccAfuCfaaagcsusu | 744 | AAGCUUUGAUGGAUUCUAAUCUU | 946 |
| AD-354079.1 | csusgacgUfuAfCfAfucauacacauL96 | 544 | asUfsgugu(Agn)ugauguAfaCfgucagsusu | 745 | AACUGACGUUACAUCAUACACAG | 947 |
| AD-356639.1 | csusgcuuUfaGfUfCfgagaaccaauL96 | 545 | asUfsuggu(Tgn)cucgacUfaAfagcagsgsa | 746 | UCCUGCUUUAGUCGAGAACCAAU | 948 |
| AD-357649.1 | usgsuucgUfcAfCfUfccaaacacaaL96 | 546 | usUfsgugu(Tgn)uggaguGfaCfgaacasusa | 747 | UAUGUUCGUCACUCCAAACACAA | 949 |
| AD-361496.1 | usgsacuuGfuUfUfAfcgaaaugucuL96 | 547 | asGfsacau(Tgn)ucguaaAfcAfagucasgsc | 748 | GCUGACUUGUUUACGAAAUGUCC | 950 |
| AD-382777.1 | gsusguugAfuGfCfAfcucuccuaguL96 | 548 | asCfsuagg(Agn)gagugcAfuCfaacacscsa | 749 | UGGUGUUGAUGCACUCUCCUAGU | 951 |
| AD-353525.1 | gsasuucuAfaUfCfUfuccaagguuaL96 | 549 | usAfsaccu(Tgn)ggaagaUfuAfgaaucscsa | 750 | UGGAUUCUAAUCUUCCAAGGUUA | 952 |
| AD-358480.1 | csuscguuGfuGfAfAfaaccuuucaaL96 | 550 | usUfsgaaa(Ggn)guuuucAfcAfacgagsasc | 751 | GUCUCGUUGUGAAAACCUUUCAA | 953 |
| AD-356388.1 | uscsuagaCfaAfUfCfugauaccucaL96 | 551 | usGfsaggu(Agn)ucagauUfgUfcuagasasg | 752 | CUUCUAGACAAUCUGAUACCUCA | 954 |
| AD-353500.1 | csasacaaAfgUfUfAfucaaagcuuuL96 | 552 | asAfsagcu(Tgn)ugauaaCfuUfuguugsasg | 753 | CUCAACAAAGUUAUCAAAGCUUU | 955 |
| AD-356407.1 | csasggucCfuGfUfUfacaacaaguaL96 | 553 | usAfscuug(Tgn)uguaacAfgGfaccugsasg | 754 | CUCAGGUCCUGUUACAACAAGUA | 956 |

TABLE 3-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-357068.1 | gsusucagUfuAfCfGfgguuaauuauL96 | 554 | asUfsaauu(Agn)acccguAfaCfugaacsesa | 755 | UGGUUCAGUUACGGGUUAAUUAC | 957 |
| AD-359802.1 | cscsagucGfuAfCfUfcaguuugaauL96 | 555 | asUfsucaa(Agn)cugaguAfcGfacuggsusc | 756 | GACCAGUCGUACUCAGUUUGAAG | 958 |
| AD-354638.1 | uscsugaaAfuUfGfUfguuagacgguL96 | 556 | asCfscguc(Tgn)aacacaAfuUfucagasasc | 757 | GUUCUGAAAUUGUGUUAGACGGU | 959 |
| AD-356663.1 | gsgscaacUfgUfUfUfguguucaacaL96 | 557 | usGfsuuga(Agn)cacaaaCfaGfuugccsasu | 758 | AUGGCAACUGUUUGUGUUCAACA | 960 |
| AD-357651.1 | ususcgucAfcUfCfCfaaacacaauuL96 | 558 | asAfsuugu(Ggn)uuggaGfuGfacgaascsa | 759 | UGUUCGUCACUCCAAACACAAUG | 961 |
| AD-362085.1 | csusgacaUfuUfCfCfguuguacauuL96 | 559 | asAfsugua(Cgn)aacggaAfaUfgucagscsg | 760 | CGCUGACAUUUCCGUUGUACAUG | 962 |
| AD-384329.1 | cscsacugCfcAfAfGfugcccuuuauL96 | 560 | asUfsaaag(Ggn)gcacuuGfgCfaguggscsu | 761 | AGCCACUGCCAAGUGCCCUUUAU | 963 |
| AD-354067.1 | csasgguuUfaUfGfAfacugacguuaL96 | 561 | usAfsacgu(Cgn)aguucaUfaAfacugsgsa | 762 | UCCAGGUUUAUGAACUGACGUUA | 964 |
| AD-353526.1 | asusucuaAfuCfUfUfccaagguuauL96 | 562 | asUfsaacc(Tgn)uggaagAfuUfagaauscsc | 763 | GGAUUCUAAUCUUCCAAGGUUAC | 965 |
| AD-356422.1 | csasaguaAfaUfCfCfucaucacuguL96 | 563 | asCfsagug(Agn)ugagaUfuUfacuugsusu | 764 | AACAAGUAAAUCCUCAUCACUGG | 966 |
| AD-353519.1 | ususgaugGfaUfUfCfuaaucuuccaL96 | 564 | usGfsgaag(Agn)uuagaaUfcCfaucaasasg | 765 | CUUUGAUGGAUUCUAAUCUUCCA | 967 |
| AD-356443.1 | csusucauAfcCfUfCfaaacugcauuL96 | 565 | asAfsugca(Ggn)uuugagGfuAfugaagsgsa | 766 | UCCUUCAUACCUCAAACUGCAUG | 968 |
| AD-357115.1 | usasuuggCfuUfUfGfuauugaaacaL96 | 566 | usGfsuuuc(Agn)auacaaAfgCfcaauasasa | 767 | UUUAUUGGCUUUGUAUUGAAACA | 969 |
| AD-361493.1 | usgscugaCfuUfGfUfuuacgaaauuL96 | 567 | asAfsuuuc(Ggn)uaaacaAfgUfcagcasgsc | 768 | GCUGCUGACUUGUUUACGAAAUG | 970 |
| AD-354639.1 | csusgaaaUfuGfUfGfuuagacgguaL96 | 568 | usAfsccgu(Cgn)uaacacAfaUfuucagsasa | 769 | UUCUGAAAUUGUGUUAGACGGUA | 971 |
| AD-356955.1 | ususcauaAfuCfAfCfauucguuuguL96 | 569 | asCfsaaac(Ggn)aaugugAfuUfaugaasusa | 770 | UAUUCAUAAUCACAUUCGUUUGU | 972 |
| AD-358471.1 | csasauucAfgUfCfUfcguugugaaaL96 | 570 | usUfsucac(Agn)acgagaCfuGfaauugscsc | 771 | GGCAAUUCAGUCUCGUUGUGAAA | 973 |
| AD-354066.1 | cscsagguUfuAfUfGfaacugacguuL96 | 571 | asAfscguc(Agn)guucauAfaAfccuggsasc | 772 | GUCCAGGUUUAUGAACUGACGUU | 974 |
| AD-384665.1 | cscsuccaGfgGfAfUfugguauguguL96 | 572 | asCfsacau(Agn)ccaaucCfcUfggaggsasc | 773 | GUCCUCCAGGGAUUGGUAUGUGG | 975 |
| AD-355045.1 | usususcuuCfaGfCfAfaacucuauaaL96 | 573 | usUfsauag(Agn)guuugcUfgAfagaaasgsa | 774 | UCUUUCUUCAGCAAACUCUAUAA | 976 |
| AD-353715.1 | usgsuuccCfaAfAfAfuuauggcuuuL96 | 574 | asAfsagcc(Agn)uaauuuUfgGfgaacasgsc | 775 | GCUGUUCCCAAAAUUAUGGCUUC | 977 |
| AD-356429.1 | ususucuaUfcAfUfCfuuccuucauaL96 | 575 | usAfsugaa(Ggn)gaagauGfaUfagaaascsu | 776 | AGUUUCUAUCAUCUUCCUUCAUA | 978 |
| AD-359761.1 | csusuuaaGfgAfGfUfucaucuaccuL96 | 576 | asGfsguag(Agn)ugaacuCfcUfuaaagsasc | 777 | GUCUUUAAGGAGUUCAUCUACCG | 979 |
| AD-356669.1 | usgsuuugUfgUfUfCfaacaauuguuL96 | 577 | asAfscaau(Tgn)guugaaCfaCfaaacasgsu | 778 | ACUGUUUGUGUUCAACAAUUGUU | 980 |
| AD-357684.1 | ascsuguuCfaAfCfUfguggauaucuL96 | 578 | asGfsauau(Cgn)cacaguUfgAfacagusgsc | 779 | GCACUGUUCAACUGUGGAUAUCG | 981 |
| AD-361981.1 | usasacguAfaCfUfCfuuucuaugcuL96 | 579 | asGfscaua(Ggn)aaagagUfuAfcguuasasa | 780 | UUUAACGUAACUCUUUCUAUGCC | 982 |
| AD-355423.1 | uscsugagGfaAfCfAfguuccuauuuL96 | 580 | asAfsauag(Ggn)aacuguUfcCfucagasgsu | 781 | ACUCUGAGGAACAGUUCCUAUUG | 983 |
| AD-356956.1 | uscsauaaUfcAfCfAfuucguuuguuL96 | 581 | asAfscaaa(Cgn)gaaugUfgAfuuaugasasu | 782 | AUUCAUAAUCACAUUCGUUUGUU | 984 |

TABLE 3-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-353522.1 | asusggauUfcUfAfAfucuuccaaguL96 | 582 | asCfsuugg(Agn)agauuaGfaAfuccauscsa | 783 | UGAUGGAUUCUAAUCUUCCAAGG | 985 |
| AD-354075.1 | usgsaacuGfaCfGfUfuacaucauauL96 | 583 | asUfsauga(Tgn)guaacgUfcAfguucasusa | 784 | UAUGAACUGACGUUACAUCAUAC | 986 |
| AD-355059.1 | uscsuauaAfaGfUfUfccucuugacaL96 | 584 | usGfsucaa(Ggn)aggaacUfuUfauagasgsu | 785 | ACUCUAUAAAGUUCCUCUUGACA | 987 |
| AD-356951.1 | gscsuauuCfaUfAfAfucacauucguL96 | 585 | asCfsgaau(Ggn)ugauuaUfgAfauagcsasu | 786 | AUGCUAUUCAUAAUCACAUUCGU | 988 |
| AD-353871.1 | gscsuacuAfaAfUfGfugcucuuaguL96 | 586 | asCfsuaag(Agn)gcacauUfuAfguagcscsa | 787 | UGGCUACUAAAUGUGCUCUUAGG | 989 |
| AD-356996.1 | gscsuuuaAfaAfCfAfguacacgacuL96 | 587 | asGfsucgu(Ggn)uacuguUfuUfaaagcsusu | 788 | AAGCUUUAAAACAGUACACGACU | 990 |
| AD-354068.1 | asgsguuuAfuGfAfAfcugacguuauL96 | 588 | asUfsaacg(Tgn)caguucAfuAfaaccusgsg | 789 | CCAGGUUUAUGAACUGACGUUAC | 991 |
| AD-356678.1 | uscsaacaAfuUfGfUfugaagacucuL96 | 589 | asGfsaguc(Tgn)ucaacaAfuUfguugasasc | 790 | GUUCAACAAUUGUUGAAGACUCU | 992 |
| AD-357963.1 | gscsaacaUfaCfUfUfucuauugccaL96 | 590 | usGfsgcaa(Tgn)agaaagUfaUfguugcsusg | 791 | CAGCAACAUACUUUCUAUUGCCA | 993 |
| AD-362090.1 | asusuuccGfuUfGfUfacauguuccuL96 | 591 | asGfsgaac(Agn)uguacaAfcGfgaaausgsu | 792 | ACAUUUCCGUUGUACAUGUUCCU | 994 |
| AD-355745.1 | csusccguCfaGfCfAfcaauaaccauL96 | 592 | asUfsgguu(Agn)uugugcUfgAfcggagsasa | 793 | UUCUCCGUCAGCACAAUAACCAG | 995 |
| AD-357066.1 | usgsguucAfgUfUfAfcggguuaauuL96 | 593 | asAfsuuaa(Cgn)ccguaaCfuGfaaccasgsc | 794 | GCUGGUUCAGUUACGGGUUAAUU | 996 |
| AD-353527.1 | ususcuaaUfcUfUfCfcaagguuacaL96 | 594 | usGfsuaac(Cgn)uuggaaGfaUfuagaasusc | 795 | GAUUCUAAUCUUCCAAGGUUACA | 997 |
| AD-354236.1 | gsasguauUfgUfGfGfaacuuauaguL96 | 595 | asCfsuaua(Agn)guuccaCfaAfuacucscsc | 796 | GGGAGUAUUGUGGAACUUAUAGC | 998 |
| AD-357750.1 | gsasuauuGfuUfCfUfuucucguauuL96 | 596 | asAfsuacg(Agn)gaaagaAfcAfauaucsusu | 797 | AAGAUAUUGUUCUUUCUCGUAUU | 999 |
| AD-356389.1 | csusagacAfaUfCfUfgauaccucauL96 | 597 | asUfsgagg(Tgn)aucagaUfuGfucuagsasa | 798 | UUCUAGACAAUCUGAUACCUCAG | 1000 |
| AD-354939.1 | csgsccuuUfuAfUfCfugcuucguuuL96 | 598 | asAfsacga(Agn)gcagauAfaAfaggcgsgsa | 799 | UCCGCCUUUUAUCUGCUUCGUUU | 1001 |
| AD-357218.1 | usasugaaCfgCfUfAfucauucaaaaL96 | 599 | usUfsuuga(Agn)ugauagCfgUfucauasasg | 800 | CUUAUGAACGCUAUCAUUCAAAA | 1002 |
| AD-354640.1 | usgsaaauUfgUfGfUfuagacgguauL96 | 600 | asUfsaccg(Tgn)cuaacaCfaAfuuucasgsa | 801 | UCUGAAAUUGUGUUAGACGGUAC | 1003 |
| AD-358018.1 | asuscuucAfaGfUfCfuggaauguuuL96 | 601 | asAfsacau(Tgn)ccagacUfuGfaagausgsu | 802 | ACAUCUUCAAGUCUGGAAUGUUC | 1004 |
| AD-362093.1 | uscscguuGfuAfCfAfuguuccuguuL96 | 602 | asAfscagg(Agn)acauguAfcAfacggasasa | 803 | UUUCCGUUGUACAUGUUCCUGUU | 1005 |
| AD-356385.1 | gscsuucuAfgAfCfAfaucugauacuL96 | 603 | asGfsuauc(Agn)gauuguCfuAfgaagcsusg | 804 | CAGCUUCUAGACAAUCUGAUACC | 1006 |
| AD-357069.1 | ususcaguUfaCfGfGfguuaauuacuL96 | 604 | asGfsuaau(Tgn)aacccgUfaAfcugaascsc | 805 | GGUUCAGUUACGGGUUAAUUACU | 1007 |
| AD-358764.1 | csasugcaAfgAfCfUfcacuuagucuL96 | 605 | asGfsacua(Agn)gugaguCfuUfgcaugsgsu | 806 | ACCAUGCAAGACUCACUUAGUCC | 1008 |
| AD-354316.1 | gsasugacUfcUfGfAfaucgagaucuL96 | 606 | asGfsaucu(Cgn)gauucaGfaGfucaucscsu | 807 | AGGAUGACUCUGAAUCGAGAUCG | 1009 |
| AD-355775.1 | asgsgcuaUfaAfCfCfuacuaccaauL96 | 607 | asUfsuggu(Agn)guagguUfaUfagccuscsu | 808 | AGAGGCUAUAACCUACUACCAAG | 1010 |
| AD-354320.1 | ascsucugAfaUfCfGfagaucggauuL96 | 608 | asAfsuccg(Agn)ucucgaUfuCfagaguscsa | 809 | UGACUCUGAAUCGAGAUCGGAUG | 1011 |
| AD-355783.1 | ascscuacUfaCfCfAfagcauaacauL96 | 609 | asUfsguua(Tgn)gcuuggUfaGfuaggusgsa | 810 | UAACCUACUACCAAGCAUAACAG | 1012 |

TABLE 3-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-354322.1 | uscsugaaUfcGfAfGfaucggauguuL96 | 610 | asAfscauc(Cgn)gaucucGfaUfucagasgsu | 811 | ACUCUGAAUCGAGAUCGGAUGUC | 1013 |
| AD-356408.1 | asgsguccUfgUfUfAfcaacaaguaaL96 | 611 | usUfsacuu(Ggn)uuguaaCfaGfgaccusgsa | 812 | UCAGGUCCUGUUACAACAAGUAA | 1014 |
| AD-354805.1 | ascsagcaGfuGfUfUfgauaaauuugL96 | 612 | csAfsaauu(Tgn)aucaacAfcUfgcuguscsa | 813 | UGACAGCAGUGUUGAUAAAUUUG | 1015 |
| AD-356409.1 | gsgsuccuGfuUfAfCfaacaaguaaaL96 | 613 | usUfsuacu(Tgn)guuguaAfcAfggaccsusg | 814 | CAGGUCCUGUUACAACAAGUAAA | 1016 |
| AD-355118.1 | ususgaacUfaCfAfUfcgaucauggaL96 | 614 | usCfscaug(Agn)ucgaugUfaGfuucaasgsa | 815 | UCUUGAACUACAUCGAUCAUGGA | 1017 |
| AD-358958.1 | ascsucggAfgUfUfCfaaccuaagcuL96 | 615 | asGfscuua(Ggn)guugaaCfuCfcgagususc | 816 | GAACUCGGAGUUCAACCUAAGCC | 1018 |
| AD-355422.1 | csuscugaGfgAfAfCfaguuccuauuL96 | 616 | asAfsuagg(Agn)acuguuCfcUfcagagsusc | 817 | GACUCUGAGGAACAGUUCCUAUU | 1019 |
| AD-358959.1 | csuscggaGfuUfCfAfaccuaagccuL96 | 494 | asGfsgcuu(Agn)gguugaAfcUfccgagsusu | 818 | AACUCGGAGUUCAACCUAAGCCU | 1020 |
| AD-355424.1 | csusgaggAfaCfAfGfuuccuauuguL96 | 617 | asCfsaaua(Ggn)gaacugUfuCfcucagsasg | 819 | CUCUGAGGAACAGUUCCUAUUGG | 1021 |
| AD-379420.2 | gscsucggAfgUfUfCfaaccuaagcuL96 | 482 | asGfscuua(Ggn)guugaaCfuCfcgagcsusc | 683 | GAGCUCGGAGUUCAACCUAAGCC | 885 |
| AD-355524.1 | asuscauuAfuAfCfAfgggcuuuuaaL96 | 618 | usUfsaaaa(Ggn)cccuguAfuAfaugausgsa | 820 | UCAUCAUUAUACAGGGCUUUUAA | 1022 |
| AD-379380.2 | csuscggaGfuUfCfAfaccuaagccuL96 | 494 | asGfsgcuu(Agn)gguugaAfcUfccgagscsu | 695 | AGGCUUAGGUUGAACUCCGAGCU | 292 |

TABLE 5

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953583.1 | GCUGCCGGGACGGGUCCAA | 1023 | 1-19 | UUGGACCCGUCCCGGCAGC | 1194 | 1-19 |
| AD-953591.1 | GACGGGUCCAAGAUGGACG | 1024 | 9-27 | CGUCCAUCUUGGACCCGUC | 1195 | 9-27 |
| AD-953599.1 | CAAGAUGGACGGCCGCUCA | 1025 | 17-35 | UGAGCGGCCGUCCAUCUUG | 1196 | 17-35 |
| AD-953607.1 | ACGGCCGCUCAGGUUCUGC | 1026 | 25-43 | GCAGAACCUGAGCGGCCGU | 1197 | 25-43 |
| AD-953615.1 | UCAGGUUCUGCUUUUACCU | 1027 | 33-51 | AGGUAAAAGCAGAACCUGA | 1198 | 33-51 |
| AD-953623.1 | UGCUUUUACCUGCGGCCCA | 1028 | 41-59 | UGGGCCGCAGGUAAAAGCA | 1199 | 41-59 |
| AD-953630.1 | ACCUGCGGCCCAGAGCCCC | 1029 | 48-66 | GGGGCUCUGGGCCGCAGGU | 1200 | 48-66 |
| AD-953638.1 | CCCAGAGCCCCAUUCAUUG | 1030 | 56-74 | CAAUGAAUGGGGCUCUGGG | 1201 | 56-74 |
| AD-953646.1 | CCCAUUCAUUGCCCCGGUG | 1031 | 64-82 | CACCGGGGCAAUGAAUGGG | 1202 | 64-82 |
| AD-953654.1 | UUGCCCCGGUGCUGAGCGG | 1032 | 72-90 | CCGCUCAGCACCGGGGCAA | 1203 | 72-90 |
| AD-953662.1 | GUGCUGAGCGGCGCCGCGA | 1033 | 80-98 | UCGCGGCGCCGCUCAGCAC | 1204 | 80-98 |
| AD-953670.1 | CGGCGCCGCGAGUCGGCCC | 1034 | 88-106 | GGGCCGACUCGCGGCGCCG | 1205 | 88-106 |
| AD-953584.1 | CUGCCGGGACGGGUCCAAG | 1035 | 2-20 | CUUGGACCCGUCCCGGCAG | 1206 | 2-20 |
| AD-953592.1 | ACGGGUCCAAGAUGGACGG | 1036 | 10-28 | CCGUCCAUCUUGGACCCGU | 1207 | 10-28 |
| AD-953600.1 | AAGAUGGACGGCCGCUCAG | 1037 | 18-36 | CUGAGCGGCCGUCCAUCUU | 1208 | 18-36 |
| AD-953608.1 | CGGCCGCUCAGGUUCUGCU | 1038 | 26-44 | AGCAGAACCUGAGCGGCCG | 1209 | 26-44 |

TABLE 5-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953616.1 | CAGGUUCUGCUUUUACCUG | 1039 | 34-52 | CAGGUAAAAGCAGAACCUG | 1210 | 34-52 |
| AD-953624.1 | GCUUUUACCUGCGGCCCAG | 1040 | 42-60 | CUGGGCCGCAGGUAAAAGC | 1211 | 42-60 |
| AD-953631.1 | CCUGCGGCCCAGAGCCCCA | 1041 | 49-67 | UGGGGCUCUGGGCCGCAGG | 1212 | 49-67 |
| AD-953639.1 | CCAGAGCCCCAUUCAUUGC | 1042 | 57-75 | GCAAUGAAUGGGGCUCUGG | 1213 | 57-75 |
| AD-953647.1 | CCAUUCAUUGCCCCGGUGC | 1043 | 65-83 | GCACCGGGGCAAUGAAUGG | 1214 | 65-83 |
| AD-953655.1 | UGCCCCGGUGCUGAGCGGC | 1044 | 73-91 | GCCGCUCAGCACCGGGGCA | 1215 | 73-91 |
| AD-953663.1 | UGCUGAGCGGCGCCGCGAG | 1045 | 81-99 | CUCGCGGCGCCGCUCAGCA | 1216 | 81-99 |
| AD-953671.1 | GGCGCCGCGAGUCGGCCCG | 1046 | 89-107 | CGGGCCGACUCGCGGCGCC | 1217 | 89-107 |
| AD-953585.1 | UGCCGGGACGGGUCCAAGA | 1047 | 3-21 | UCUUGGACCCGUCCCGGCA | 1218 | 3-21 |
| AD-953593.1 | CGGGUCCAAGAUGGACGGC | 1048 | 11-29 | GCCGUCCAUCUUGGACCCG | 1219 | 11-29 |
| AD-953601.1 | AGAUGGACGGCCGCUCAGG | 1049 | 19-37 | CCUGAGCGGCCGUCCAUCU | 1220 | 19-37 |
| AD-953609.1 | GGCCGCUCAGGUUCUGCUU | 1050 | 27-45 | AAGCAGAACCUGAGCGGCC | 1221 | 27-45 |
| AD-953617.1 | AGGUUCUGCUUUUACCUGC | 1051 | 35-53 | GCAGGUAAAAGCAGAACCU | 1222 | 35-53 |
| AD-953625.1 | CUUUUACCUGCGGCCCAGA | 1052 | 43-61 | UCUGGGCCGCAGGUAAAAG | 1223 | 43-61 |
| AD-953632.1 | CUGCGGCCCAGAGCCCCAU | 1053 | 50-68 | AUGGGGCUCUGGGCCGCAG | 1224 | 50-68 |
| AD-953640.1 | CAGAGCCCCAUUCAUUGCC | 1054 | 58-76 | GGCAAUGAAUGGGGCUCUG | 1225 | 58-76 |
| AD-953648.1 | CAUUCAUUGCCCCGGUGCU | 1055 | 66-84 | AGCACCGGGGCAAUGAAUG | 1226 | 66-84 |
| AD-953656.1 | GCCCCGGUGCUGAGCGGCG | 1056 | 74-92 | CGCCGCUCAGCACCGGGGC | 1227 | 74-92 |
| AD-953664.1 | GCUGAGCGGCGCCGCGAGU | 1057 | 82-100 | ACUCGCGGCGCCGCUCAGC | 1228 | 82-100 |
| AD-953672.1 | GCGCCGCGAGUCGGCCCGA | 1058 | 90-108 | UCGGGCCGACUCGCGGCGC | 1229 | 90-108 |
| AD-953586.1 | GCCGGGACGGGUCCAAGAU | 1059 | 4-22 | AUCUUGGACCCGUCCCGGC | 1230 | 4-22 |
| AD-953594.1 | GGGUCCAAGAUGGACGGCC | 1060 | 12-30 | GGCCGUCCAUCUUGGACCC | 1231 | 12-30 |
| AD-953602.1 | GAUGGACGGCCGCUCAGGU | 1061 | 20-38 | ACCUGAGCGGCCGUCCAUC | 1232 | 20-38 |
| AD-953610.1 | GCCGCUCAGGUUCUGCUUU | 1062 | 28-46 | AAAGCAGAACCUGAGCGGC | 1233 | 28-46 |
| AD-953618.1 | GGUUCUGCUUUUACCUGCG | 1063 | 36-54 | CGCAGGUAAAAGCAGAACC | 1234 | 36-54 |
| AD-953626.1 | UUUUACCUGCGGCCCAGAG | 1064 | 44-62 | CUCUGGGCCGCAGGUAAAA | 1235 | 44-62 |
| AD-953633.1 | UGCGGCCCAGAGCCCCAUU | 1065 | 51-69 | AAUGGGGCUCUGGGCCGCA | 1236 | 51-69 |
| AD-953641.1 | AGAGCCCCAUUCAUUGCCC | 1066 | 59-77 | GGGCAAUGAAUGGGGCUCU | 1237 | 59-77 |
| AD-953649.1 | AUUCAUUGCCCCGGUGCUG | 1067 | 67-85 | CAGCACCGGGGCAAUGAAU | 1238 | 67-85 |
| AD-953657.1 | CCCCGGUGCUGAGCGGCGC | 1068 | 75-93 | GCGCCGCUCAGCACCGGGG | 1239 | 75-93 |
| AD-953665.1 | CUGAGCGGCGCCGCGAGUC | 1069 | 83-101 | GACUCGCGGCGCCGCUCAG | 1240 | 83-101 |
| AD-953673.1 | CGCCGCGAGUCGGCCCGAG | 1070 | 91-109 | CUCGGGCCGACUCGCGGCG | 1241 | 91-109 |
| AD-953587.1 | CCGGGACGGGUCCAAGAUG | 1071 | 5-23 | CAUCUUGGACCCGUCCCGG | 1242 | 5-23 |
| AD-953595.1 | GGUCCAAGAUGGACGGCCG | 1072 | 13-31 | CGGCCGUCCAUCUUGGACC | 1243 | 13-31 |
| AD-953603.1 | AUGGACGGCCGCUCAGGUU | 1073 | 21-39 | AACCUGAGCGGCCGUCCAU | 1244 | 21-39 |
| AD-953611.1 | CCGCUCAGGUUCUGCUUUU | 1074 | 29-47 | AAAAGCAGAACCUGAGCGG | 1245 | 29-47 |
| AD-953619.1 | GUUCUGCUUUUACCUGCGG | 1075 | 37-55 | CCGCAGGUAAAAGCAGAAC | 1246 | 37-55 |

TABLE 5-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953627.1 | UUUACCUGCGGCCCAGAGC | 1076 | 45-63 | GCUCUGGGCCGCAGGUAAA | 1247 | 45-63 |
| AD-953634.1 | GCGGCCCAGAGCCCCAUUC | 1077 | 52-70 | GAAUGGGGCUCUGGGCCGC | 1248 | 52-70 |
| AD-953642.1 | GAGCCCCAUUCAUUGCCCC | 1078 | 60-78 | GGGGCAAUGAAUGGGGCUC | 1249 | 60-78 |
| AD-953650.1 | UUCAUUGCCCCGGUGCUGA | 1079 | 68-86 | UCAGCACCGGGGCAAUGAA | 1250 | 68-86 |
| AD-953658.1 | CCCGGUGCUGAGCGGCGCC | 1080 | 76-94 | GGCGCCGCUCAGCACCGGG | 1251 | 76-94 |
| AD-953666.1 | UGAGCGGCGCCGCGAGUCG | 1081 | 84-102 | CGACUCGCGGCGCCGCUCA | 1252 | 84-102 |
| AD-953674.1 | GCCGCGAGUCGGCCCGAGG | 1082 | 92-110 | CCUCGGGCCGACUCGCGGC | 1253 | 92-110 |
| AD-953588.1 | CGGGACGGGUCCAAGAUGG | 1083 | 6-24 | CCAUCUUGGACCCGUCCCG | 1254 | 6-24 |
| AD-953596.1 | GUCCAAGAUGGACGGCCGC | 1084 | 14-32 | GCGGCCGUCCAUCUUGGAC | 1255 | 14-32 |
| AD-953604.1 | UGGACGGCCGCUCAGGUUC | 1085 | 22-40 | GAACCUGAGCGGCCGUCCA | 1256 | 22-40 |
| AD-953612.1 | CGCUCAGGUUCUGCUUUUA | 1086 | 30-48 | UAAAAGCAGAACCUGAGCG | 1257 | 30-48 |
| AD-953620.1 | UUCUGCUUUUACCUGCGGC | 1087 | 38-56 | GCCGCAGGUAAAAGCAGAA | 1258 | 38-56 |
| AD-953628.1 | UUACCUGCGGCCCAGAGCC | 1088 | 46-64 | GGCUCUGGGCCGCAGGUAA | 1259 | 46-64 |
| AD-953635.1 | CGGCCCAGAGCCCCAUUCA | 1089 | 53-71 | UGAAUGGGGCUCUGGGCCG | 1260 | 53-71 |
| AD-953643.1 | AGCCCCAUUCAUUGCCCCG | 1090 | 61-79 | CGGGGCAAUGAAUGGGGCU | 1261 | 61-79 |
| AD-953651.1 | UCAUUGCCCCGGUGCUGAG | 1091 | 69-87 | CUCAGCACCGGGGCAAUGA | 1262 | 69-87 |
| AD-953659.1 | CCGGUGCUGAGCGGCGCCG | 1092 | 77-95 | CGGCGCCGCUCAGCACCGG | 1263 | 77-95 |
| AD-953667.1 | GAGCGGCGCCGCGAGUCGG | 1093 | 85-103 | CCGACUCGCGGCGCCGCUC | 1264 | 85-103 |
| AD-953675.1 | CCGCGAGUCGGCCCGAGGC | 1094 | 93-111 | GCCUCGGGCCGACUCGCGG | 1265 | 93-111 |
| AD-953589.1 | GGGACGGGUCCAAGAUGGA | 1095 | 7-25 | UCCAUCUUGGACCCGUCCC | 1266 | 7-25 |
| AD-953597.1 | UCCAAGAUGGACGGCCGCU | 1096 | 15-33 | AGCGGCCGUCCAUCUUGGA | 1267 | 15-33 |
| AD-953605.1 | GGACGGCCGCUCAGGUUCU | 1097 | 23-41 | AGAACCUGAGCGGCCGUCC | 1268 | 23-41 |
| AD-953613.1 | GCUCAGGUUCUGCUUUUAC | 1098 | 31-49 | GUAAAAGCAGAACCUGAGC | 1269 | 31-49 |
| AD-953621.1 | UCUGCUUUUACCUGCGGCC | 1099 | 39-57 | GGCCGCAGGUAAAAGCAGA | 1270 | 39-57 |
| AD-953629.1 | UACCUGCGGCCCAGAGCCC | 1100 | 47-65 | GGGCUCUGGGCCGCAGGUA | 1271 | 47-65 |
| AD-953636.1 | GGCCCAGAGCCCCAUUCAU | 1101 | 54-72 | AUGAAUGGGGCUCUGGGCC | 1272 | 54-72 |
| AD-953644.1 | GCCCCAUUCAUUGCCCCGG | 1102 | 62-80 | CCGGGGCAAUGAAUGGGGC | 1273 | 62-80 |
| AD-953652.1 | CAUUGCCCCGGUGCUGAGC | 1103 | 70-88 | GCUCAGCACCGGGGCAAUG | 1274 | 70-88 |
| AD-953660.1 | CGGUGCUGAGCGGCGCCGC | 1104 | 78-96 | GCGGCGCCGCUCAGCACCG | 1275 | 78-96 |
| AD-953676.1 | CGCGAGUCGGCCCGAGGCC | 1105 | 94-112 | GGCCUCGGGCCGACUCGCG | 1276 | 94-112 |
| AD-953590.1 | GGACGGGUCCAAGAUGGAC | 1106 | 8-26 | GUCCAUCUUGGACCCGUCC | 1277 | 8-26 |
| AD-953598.1 | CCAAGAUGGACGGCCGCUC | 1107 | 16-34 | GAGCGGCCGUCCAUCUUGG | 1278 | 16-34 |
| AD-953606.1 | GACGGCCGCUCAGGUUCUG | 1108 | 24-42 | CAGAACCUGAGCGGCCGUC | 1279 | 24-42 |
| AD-953614.1 | CUCAGGUUCUGCUUUUACC | 1109 | 32-50 | GGUAAAAGCAGAACCUGAG | 1280 | 32-50 |
| AD-953622.1 | CUGCUUUUACCUGCGGCCC | 1110 | 40-58 | GGGCCGCAGGUAAAAGCAG | 1281 | 40-58 |
| AD-953637.1 | GCCCAGAGCCCCAUUCAUU | 1111 | 55-73 | AAUGAAUGGGGCUCUGGGC | 1282 | 55-73 |
| AD-953645.1 | CCCCAUUCAUUGCCCCGGU | 1112 | 63-81 | ACCGGGGCAAUGAAUGGGG | 1283 | 63-81 |

TABLE 5-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953653.1 | AUUGCCCCGGUGCUGAGCG | 1113 | 71-89 | CGCUCAGCACCGGGGCAAU | 1284 | 71-89 |
| AD-953661.1 | GGUGCUGAGCGGCGCCGCG | 1114 | 79-97 | CGCGGCGCCGCUCAGCACC | 1285 | 79-97 |
| AD-953677.1 | GCGAGUCGGCCCGAGGCCU | 1115 | 95-113 | AGGCCUCGGGCCGACUCGC | 1286 | 95-113 |
| AD-953685.1 | GCCCGAGGCCUCCGGGGAC | 1116 | 103-121 | GUCCCCGGAGGCCUCGGGC | 1287 | 103-121 |
| AD-953693.1 | CCUCCGGGGACUGCCGUGC | 1117 | 111-129 | GCACGGCAGUCCCCGGAGG | 1288 | 111-129 |
| AD-953701.1 | GACUGCCGUGCCGGGCGGG | 1118 | 119-137 | CCCGCCCGGCACGGCAGUC | 1289 | 119-137 |
| AD-953709.1 | UGCCGGGCGGGAGACCGCC | 1119 | 127-145 | GGCGGUCUCCCGCCCGGCA | 1290 | 127-145 |
| AD-953717.1 | GGGAGACCGCCAUGGCGAC | 1120 | 135-153 | GUCGCCAUGGCGGUCUCCC | 1291 | 135-153 |
| AD-953724.1 | CGCCAUGGCGACCCUGGAA | 1121 | 142-160 | UUCCAGGGUCGCCAUGGCG | 1292 | 142-160 |
| AD-953732.1 | CGACCCUGGAAAAGCUGAU | 1122 | 150-168 | AUCAGCUUUUCCAGGGUCG | 1293 | 150-168 |
| AD-953702.1 | ACUGCCGUGCCGGGCGGGA | 1123 | 120-138 | UCCCGCCCGGCACGGCAGU | 1294 | 120-138 |
| AD-953710.1 | GCCGGGCGGGAGACCGCCA | 1124 | 128-146 | UGGCGGUCUCCCGCCCGGC | 1295 | 128-146 |
| AD-953718.1 | GGAGACCGCCAUGGCGACC | 1125 | 136-154 | GGUCGCCAUGGCGGUCUCC | 1296 | 136-154 |
| AD-953733.1 | GACCCUGGAAAAGCUGAUG | 1126 | 151-169 | CAUCAGCUUUUCCAGGGUC | 1297 | 151-169 |
| AD-953741.1 | AAAAGCUGAUGAAGGCCUU | 1127 | 159-177 | AAGGCCUUCAUCAGCUUUU | 1298 | 159-177 |
| AD-953749.1 | AUGAAGGCCUUCGAGUCCC | 1128 | 167-185 | GGGACUCGAAGGCCUUCAU | 1299 | 167-185 |
| AD-953757.1 | CUUCGAGUCCCUCAAGUCC | 1129 | 175-193 | GGACUUGAGGGACUCGAAG | 1300 | 175-193 |
| AD-953679.1 | GAGUCGGCCCGAGGCCUCC | 1130 | 97-115 | GGAGGCCUCGGGCCGACUC | 1301 | 97-115 |
| AD-953687.1 | CCGAGGCCUCCGGGGACUG | 1131 | 105-123 | CAGUCCCCGGAGGCCUCGG | 1302 | 105-123 |
| AD-953695.1 | UCCGGGGACUGCCGUGCCG | 1132 | 113-131 | CGGCACGGCAGUCCCCGGA | 1303 | 113-131 |
| AD-953703.1 | CUGCCGUGCCGGGCGGGAG | 1133 | 121-139 | CUCCCGCCCGGCACGGCAG | 1304 | 121-139 |
| AD-953711.1 | CCGGGCGGGAGACCGCCAU | 1134 | 129-147 | AUGGCGGUCUCCCGCCCGG | 1305 | 129-147 |
| AD-953719.1 | GAGACCGCCAUGGCGACCC | 1135 | 137-155 | GGGUCGCCAUGGCGGUCUC | 1306 | 137-155 |
| AD-953726.1 | CCAUGGCGACCCUGGAAAA | 1136 | 144-162 | UUUUCCAGGGUCGCCAUGG | 1307 | 144-162 |
| AD-953734.1 | ACCCUGGAAAAGCUGAUGA | 1137 | 152-170 | UCAUCAGCUUUUCCAGGGU | 1308 | 152-170 |
| AD-953742.1 | AAAGCUGAUGAAGGCCUUC | 1138 | 160-178 | GAAGGCCUUCAUCAGCUUU | 1309 | 160-178 |
| AD-953750.1 | UGAAGGCCUUCGAGUCCCU | 1139 | 168-186 | AGGGACUCGAAGGCCUUCA | 1310 | 168-186 |
| AD-953758.1 | UUCGAGUCCCUCAAGUCCU | 1140 | 176-194 | AGGACUUGAGGGACUCGAA | 1311 | 176-194 |
| AD-953680.1 | AGUCGGCCCGAGGCCUCCG | 1141 | 98-116 | CGGAGGCCUCGGGCCGACU | 1312 | 98-116 |
| AD-953688.1 | CGAGGCCUCCGGGGACUGC | 1142 | 106-124 | GCAGUCCCCGGAGGCCUCG | 1313 | 106-124 |
| AD-953696.1 | CCGGGGACUGCCGUGCCGG | 1143 | 114-132 | CCGGCACGGCAGUCCCCGG | 1314 | 114-132 |
| AD-953704.1 | UGCCGUGCCGGGCGGGAGA | 1144 | 122-140 | UCUCCCGCCCGGCACGGCA | 1315 | 122-140 |
| AD-953712.1 | CGGGCGGGAGACCGCCAUG | 1145 | 130-148 | CAUGGCGGUCUCCCGCCCG | 1316 | 130-148 |
| AD-953720.1 | AGACCGCCAUGGCGACCCU | 1146 | 138-156 | AGGGUCGCCAUGGCGGUCU | 1317 | 138-156 |
| AD-953727.1 | CAUGGCGACCCUGGAAAAG | 1147 | 145-163 | CUUUUCCAGGGUCGCCAUG | 1318 | 145-163 |
| AD-953735.1 | CCCUGGAAAAGCUGAUGAA | 1148 | 153-171 | UUCAUCAGCUUUUCCAGGG | 1319 | 153-171 |
| AD-953743.1 | AAGCUGAUGAAGGCCUUCG | 1149 | 161-179 | CGAAGGCCUUCAUCAGCUU | 1320 | 161-179 |

TABLE 5-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953751.1 | GAAGGCCUUCGAGUCCCUC | 1150 | 169-187 | GAGGGACUCGAAGGCCUUC | 1321 | 169-187 |
| AD-953759.1 | UCGAGUCCCUCAAGUCCUU | 1151 | 177-195 | AAGGACUUGAGGGACUCGA | 1322 | 177-195 |
| AD-953681.1 | GUCGGCCCGAGGCCUCCGG | 1152 | 99-117 | CCGGAGGCCUCGGGCCGAC | 1323 | 99-117 |
| AD-953689.1 | GAGGCCUCCGGGGACUGCC | 1153 | 107-125 | GGCAGUCCCCGGAGGCCUC | 1324 | 107-125 |
| AD-953697.1 | CGGGGACUGCCGUGCCGGG | 1154 | 115-133 | CCCGGCACGGCAGUCCCCG | 1325 | 115-133 |
| AD-953705.1 | GCCGUGCCGGGCGGGAGAC | 1155 | 123-141 | GUCUCCCGCCCGGCACGGC | 1326 | 123-141 |
| AD-953713.1 | GGGCGGGAGACCGCCAUGG | 1156 | 131-149 | CCAUGGCGGUCUCCCGCCC | 1327 | 131-149 |
| AD-953721.1 | GACCGCCAUGGCGACCCUG | 1157 | 139-157 | CAGGGUCGCCAUGGCGGUC | 1328 | 139-157 |
| AD-953728.1 | AUGGCGACCCUGGAAAAGC | 1158 | 146-164 | GCUUUUCCAGGGUCGCCAU | 1329 | 146-164 |
| AD-953736.1 | CCUGGAAAAGCUGAUGAAG | 1159 | 154-172 | CUUCAUCAGCUUUUCCAGG | 1330 | 154-172 |
| AD-953744.1 | AGCUGAUGAAGGCCUUCGA | 1160 | 162-180 | UCGAAGGCCUUCAUCAGCU | 1331 | 162-180 |
| AD-953752.1 | AAGGCCUUCGAGUCCCUCA | 1161 | 170-188 | UGAGGGACUCGAAGGCCUU | 1332 | 170-188 |
| AD-953760.1 | CGAGUCCCUCAAGUCCUUC | 1162 | 178-196 | GAAGGACUUGAGGGACUCG | 1333 | 178-196 |
| AD-953682.1 | UCGGCCCGAGGCCUCCGGG | 1163 | 100-118 | CCCGGAGGCCUCGGGCCGA | 1334 | 100-118 |
| AD-953690.1 | AGGCCUCCGGGGACUGCCG | 1164 | 108-126 | CGGCAGUCCCCGGAGGCCU | 1335 | 108-126 |
| AD-953698.1 | GGGGACUGCCGUGCCGGGC | 1165 | 116-134 | GCCCGGCACGGCAGUCCCC | 1336 | 116-134 |
| AD-953706.1 | CCGUGCCGGGCGGGAGACC | 1166 | 124-142 | GGUCUCCCGCCCGGCACGG | 1337 | 124-142 |
| AD-953714.1 | GGCGGGAGACCGCCAUGGC | 1167 | 132-150 | GCCAUGGCGGUCUCCCGCC | 1338 | 132-150 |
| AD-953722.1 | ACCGCCAUGGCGACCCUGG | 1168 | 140-158 | CCAGGGUCGCCAUGGCGGU | 1339 | 140-158 |
| AD-953729.1 | UGGCGACCCUGGAAAAGCU | 1169 | 147-165 | AGCUUUUCCAGGGUCGCCA | 1340 | 147-165 |
| AD-953737.1 | CUGGAAAAGCUGAUGAAGG | 1170 | 155-173 | CCUUCAUCAGCUUUUCCAG | 1341 | 155-173 |
| AD-953745.1 | GCUGAUGAAGGCCUUCGAG | 1171 | 163-181 | CUCGAAGGCCUUCAUCAGC | 1342 | 163-181 |
| AD-953753.1 | AGGCCUUCGAGUCCCUCAA | 1172 | 171-189 | UUGAGGGACUCGAAGGCCU | 1343 | 171-189 |
| AD-953761.1 | GAGUCCCUCAAGUCCUUCC | 1173 | 179-197 | GGAAGGACUUGAGGGACUC | 1344 | 179-197 |
| AD-953683.1 | CGGCCCGAGGCCUCCGGGG | 1174 | 101-119 | CCCCGGAGGCCUCGGGCCG | 1345 | 101-119 |
| AD-953691.1 | GGCCUCCGGGGACUGCCGU | 1175 | 109-127 | ACGGCAGUCCCCGGAGGCC | 1346 | 109-127 |
| AD-953699.1 | GGGACUGCCGUGCCGGGCG | 1176 | 117-135 | CGCCCGGCACGGCAGUCCC | 1347 | 117-135 |
| AD-953707.1 | CGUGCCGGGCGGGAGACCG | 1177 | 125-143 | CGGUCUCCCGCCCGGCACG | 1348 | 125-143 |
| AD-953715.1 | GCGGGAGACCGCCAUGGCG | 1178 | 133-151 | CGCCAUGGCGGUCUCCCGC | 1349 | 133-151 |
| AD-953723.1 | CCGCCAUGGCGACCCUGGA | 1179 | 141-159 | UCCAGGGUCGCCAUGGCGG | 1350 | 141-159 |
| AD-953730.1 | GGCGACCCUGGAAAAGCUG | 1180 | 148-166 | CAGCUUUUCCAGGGUCGCC | 1351 | 148-166 |
| AD-953738.1 | UGGAAAAGCUGAUGAAGGC | 1181 | 156-174 | GCCUUCAUCAGCUUUUCCA | 1352 | 156-174 |
| AD-953746.1 | CUGAUGAAGGCCUUCGAGU | 1182 | 164-182 | ACUCGAAGGCCUUCAUCAG | 1353 | 164-182 |
| AD-953754.1 | GGCCUUCGAGUCCCUCAAG | 1183 | 172-190 | CUUGAGGGACUCGAAGGCC | 1354 | 172-190 |
| AD-953762.1 | AGUCCCUCAAGUCCUUCCA | 1184 | 180-198 | UGGAAGGACUUGAGGGACU | 1355 | 180-198 |
| AD-953684.1 | GGCCCGAGGCCUCCGGGGA | 1185 | 102-120 | UCCCCGGAGGCCUCGGGCC | 1356 | 102-120 |
| AD-953692.1 | GCCUCCGGGGACUGCCGUG | 1186 | 110-128 | CACGGCAGUCCCCGGAGGC | 1357 | 110-128 |

TABLE 5-continued

| Unmodified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Range in NM_002111.8 | Antisense Sequence 5' to 3' | SEQ ID NO: | Range in NM_002111.8 |
| AD-953700.1 | GGACUGCCGUGCCGGGCGG | 1187 | 118-136 | CCGCCCGGCACGGCAGUCC | 1358 | 118-136 |
| AD-953708.1 | GUGCCGGGCGGGAGACCGC | 1188 | 126-144 | GCGGUCUCCCGCCCGGCAC | 1359 | 126-144 |
| AD-953716.1 | CGGGAGACCGCCAUGGCGA | 1189 | 134-152 | UCGCCAUGGCGGUCUCCCG | 1360 | 134-152 |
| AD-953731.1 | GCGACCCUGGAAAAGCUGA | 1190 | 149-167 | UCAGCUUUUCCAGGGUCGC | 1361 | 149-167 |
| AD-953739.1 | GGAAAAGCUGAUGAAGGCC | 1191 | 157-175 | GGCCUUCAUCAGCUUUUCC | 1362 | 157-175 |
| AD-953747.1 | UGAUGAAGGCCUUCGAGUC | 1192 | 165-183 | GACUCGAAGGCCUUCAUCA | 1363 | 165-183 |
| AD-953755.1 | GCCUUCGAGUCCCUCAAGU | 1193 | 173-191 | ACUUGAGGGACUCGAAGGC | 1364 | 173-191 |

TABLE 6

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953583.1 | GCUGCCGGGACGGGUCCAAdTdT | 1365 | UUGGACCCGUCCCGGCAGCdTdT | 1536 | GCUGCCGGGACGGGUCCAA | 1023 |
| AD-953591.1 | GACGGGUCCAAGAUGGACGdTdT | 1366 | CGUCCAUCUUGGACCCGUCdTdT | 1537 | GACGGGUCCAAGAUGGACG | 1024 |
| AD-953599.1 | CAAGAUGGACGGCCGCUCAdTdT | 1367 | UGAGCGGCCGUCCAUCUUGdTdT | 1538 | CAAGAUGGACGGCCGCUCA | 1025 |
| AD-953607.1 | ACGGCCGCUCAGGUUCUGCdTdT | 1368 | GCAGAACCUGAGCGGCCGUdTdT | 1539 | ACGGCCGCUCAGGUUCUGC | 1026 |
| AD-953615.1 | UCAGGUUCUGCUUUUACCUdTdT | 1369 | AGGUAAAAGCAGAACCUGAdTdT | 1540 | UCAGGUUCUGCUUUUACCU | 1027 |
| AD-953623.1 | UGCUUUUACCUGCGGCCCAdTdT | 1370 | UGGGCCGCAGGUAAAAGCAdTdT | 1541 | UGCUUUUACCUGCGGCCCA | 1028 |
| AD-953630.1 | ACCUGCGGCCCAGAGCCCCdTdT | 1371 | GGGGCUCUGGGCCGCAGGUdTdT | 1542 | ACCUGCGGCCCAGAGCCCC | 1029 |
| AD-953638.1 | CCCAGAGCCCCAUUCAUUGdTdT | 1372 | CAAUGAAUGGGGCUCUGGGdTdT | 1543 | CCCAGAGCCCCAUUCAUUG | 1030 |
| AD-953646.1 | CCCAUUCAUUGCCCCGGUGdTdT | 1373 | CACCGGGGCAAUGAAUGGGdTdT | 1544 | CCCAUUCAUUGCCCCGGUG | 1031 |
| AD-953654.1 | UUGCCCCGGUGCUGAGCGGdTdT | 1374 | CCGCUCAGCACCGGGGCAAdTdT | 1545 | UUGCCCCGGUGCUGAGCGG | 1032 |
| AD-953662.1 | GUGCUGAGCGGCGCCGCGAdTdT | 1375 | UCGCGGCGCCGCUCAGCACdTdT | 1546 | GUGCUGAGCGGCGCCGCGA | 1033 |
| AD-953670.1 | CGGCGCCGCGAGUCGGCCCdTdT | 1376 | GGGCCGACUCGCGGCGCCGdTdT | 1547 | CGGCGCCGCGAGUCGGCCC | 1034 |
| AD-953584.1 | CUGCCGGGACGGGUCCAAGdTdT | 1377 | CUUGGACCCGUCCCGGCAGdTdT | 1548 | CUGCCGGGACGGGUCCAAG | 1035 |
| AD-953592.1 | ACGGGUCCAAGAUGGACGGdTdT | 1378 | CCGUCCAUCUUGGACCCGUdTdT | 1549 | ACGGGUCCAAGAUGGACGG | 1036 |
| AD-953600.1 | AAGAUGGACGGCCGCUCAGdTdT | 1379 | CUGAGCGGCCGUCCAUCUUdTdT | 1550 | AAGAUGGACGGCCGCUCAG | 1037 |
| AD-953608.1 | CGGCCGCUCAGGUUCUGCUdTdT | 1380 | AGCAGAACCUGAGCGGCCGdTdT | 1551 | CGGCCGCUCAGGUUCUGCU | 1038 |
| AD-953616.1 | CAGGUUCUGCUUUUACCUGdTdT | 1381 | CAGGUAAAAGCAGAACCUGdTdT | 1552 | CAGGUUCUGCUUUUACCUG | 1039 |
| AD-953624.1 | GCUUUUACCUGCGGCCCAGdTdT | 1382 | CUGGGCCGCAGGUAAAAGCdTdT | 1553 | GCUUUUACCUGCGGCCCAG | 1040 |
| AD-953631.1 | CCUGCGGCCCAGAGCCCCAdTdT | 1383 | UGGGGCUCUGGGCCGCAGGdTdT | 1554 | CCUGCGGCCCAGAGCCCCA | 1041 |
| AD-953639.1 | CCAGAGCCCCAUUCAUUGCdTdT | 1384 | GCAAUGAAUGGGGCUCUGGdTdT | 1555 | CCAGAGCCCCAUUCAUUGC | 1042 |
| AD-953647.1 | CCAUUCAUUGCCCCGGUGCdTdT | 1385 | GCACCGGGGCAAUGAAUGGdTdT | 1556 | CCAUUCAUUGCCCCGGUGC | 1043 |
| AD-953655.1 | UGCCCCGGUGCUGAGCGGCdTdT | 1386 | GCCGCUCAGCACCGGGGCAdTdT | 1557 | UGCCCCGGUGCUGAGCGGC | 1044 |
| AD-953663.1 | UGCUGAGCGGCGCCGCGAGdTdT | 1387 | CUCGCGGCGCCGCUCAGCAdTdT | 1558 | UGCUGAGCGGCGCCGCGAG | 1045 |
| AD-953671.1 | GGCGCCGCGAGUCGGCCCGdTdT | 1388 | CGGGCCGACUCGCGGCGCCdTdT | 1559 | GGCGCCGCGAGUCGGCCCG | 1046 |
| AD-953585.1 | UGCCGGGACGGGUCCAAGAdTdT | 1389 | UCUUGGACCCGUCCCGGCAdTdT | 1560 | UGCCGGGACGGGUCCAAGA | 1047 |

TABLE 6-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-953593.1 | CGGGUCCAAGAUGGACGGCdTdT | 1390 | GCCGUCCAUCUUGGACCCGdTdT | 1561 | CGGGUCCAAGAUGGACGGC | 1048 |
| AD-953601.1 | AGAUGGACGGCCGCUCAGGdTdT | 1391 | CCUGAGCGGCCGUCCAUCUdTdT | 1562 | AGAUGGACGGCCGCUCAGG | 1049 |
| AD-953609.1 | GGCCGCUCAGGUUCUGCUUdTdT | 1392 | AAGCAGAACCUGAGCGGCCdTdT | 1563 | GGCCGCUCAGGUUCUGCUU | 1050 |
| AD-953617.1 | AGGUUCUGCUUUUACCUGCdTdT | 1393 | GCAGGUAAAAGCAGAACCUdTdT | 1564 | AGGUUCUGCUUUUACCUGC | 1051 |
| AD-953625.1 | CUUUUACCUGCGGCCCAGAdTdT | 1394 | UCUGGGCCGCAGGUAAAAGdTdT | 1565 | CUUUUACCUGCGGCCCAGA | 1052 |
| AD-953632.1 | CUGCGGCCCAGAGCCCCAUdTdT | 1395 | AUGGGGCUCUGGGCCGCAGdTdT | 1566 | CUGCGGCCCAGAGCCCCAU | 1053 |
| AD-953640.1 | CAGAGCCCCAUUCAUUGCCdTdT | 1396 | GGCAAUGAAUGGGGCUCUGdTdT | 1567 | CAGAGCCCCAUUCAUUGCC | 1054 |
| AD-953648.1 | CAUUCAUUGCCCCGGUGCUdTdT | 1397 | AGCACCGGGGCAAUGAAUGdTdT | 1568 | CAUUCAUUGCCCCGGUGCU | 1055 |
| AD-953656.1 | GCCCCGGUGCUGAGCGGCGdTdT | 1398 | CGCCGCUCAGCACCGGGGCdTdT | 1569 | GCCCCGGUGCUGAGCGGCG | 1056 |
| AD-953664.1 | GCUGAGCGGCGCCGCGAGUdTdT | 1399 | ACUCGCGGCGCCGCUCAGCdTdT | 1570 | GCUGAGCGGCGCCGCGAGU | 1057 |
| AD-953672.1 | GCGCCGCGAGUCGGCCCGAdTdT | 1400 | UCGGGCCGACUCGCGGCGCdTdT | 1571 | GCGCCGCGAGUCGGCCCGA | 1058 |
| AD-953586.1 | GCCGGGACGGGUCCAAGAUdTdT | 1401 | AUCUUGGACCCGUCCCGGCdTdT | 1572 | GCCGGGACGGGUCCAAGAU | 1059 |
| AD-953594.1 | GGGUCCAAGAUGGACGGCCdTdT | 1402 | GGCCGUCCAUCUUGGACCCdTdT | 1573 | GGGUCCAAGAUGGACGGCC | 1060 |
| AD-953602.1 | GAUGGACGGCCGCUCAGGUdTdT | 1403 | ACCUGAGCGGCCGUCCAUCdTdT | 1574 | GAUGGACGGCCGCUCAGGU | 1061 |
| AD-953610.1 | GCCGCUCAGGUUCUGCUUUdTdT | 1404 | AAAGCAGAACCUGAGCGGCdTdT | 1575 | GCCGCUCAGGUUCUGCUUU | 1062 |
| AD-953618.1 | GGUUCUGCUUUUACCUGCGdTdT | 1405 | CGCAGGUAAAAGCAGAACCdTdT | 1576 | GGUUCUGCUUUUACCUGCG | 1063 |
| AD-953626.1 | UUUUACCUGCGGCCCAGAGdTdT | 1406 | CUCUGGGCCGCAGGUAAAAdTdT | 1577 | UUUUACCUGCGGCCCAGAG | 1064 |
| AD-953633.1 | UGCGGCCCAGAGCCCCAUUdTdT | 1407 | AAUGGGGCUCUGGGCCGCAdTdT | 1578 | UGCGGCCCAGAGCCCCAUU | 1065 |
| AD-953641.1 | AGAGCCCCAUUCAUUGCCCdTdT | 1408 | GGGCAAUGAAUGGGGCUCUdTdT | 1579 | AGAGCCCCAUUCAUUGCCC | 1066 |
| AD-953649.1 | AUUCAUUGCCCCGGUGCUGdTdT | 1409 | CAGCACCGGGGCAAUGAAUdTdT | 1580 | AUUCAUUGCCCCGGUGCUG | 1067 |
| AD-953657.1 | CCCCGGUGCUGAGCGGCGCdTdT | 1410 | GCGCCGCUCAGCACCGGGGdTdT | 1581 | CCCCGGUGCUGAGCGGCGC | 1068 |
| AD-953665.1 | CUGAGCGGCGCCGCGAGUCdTdT | 1411 | GACUCGCGGCGCCGCUCAGdTdT | 1582 | CUGAGCGGCGCCGCGAGUC | 1069 |
| AD-953673.1 | CGCCGCGAGUCGGCCCGAGdTdT | 1412 | CUCGGGCCGACUCGCGGCGdTdT | 1583 | CGCCGCGAGUCGGCCCGAG | 1070 |
| AD-953587.1 | CCGGGACGGGUCCAAGAUGdTdT | 1413 | CAUCUUGGACCCGUCCCGGdTdT | 1584 | CCGGGACGGGUCCAAGAUG | 1071 |
| AD-953595.1 | GGUCCAAGAUGGACGGCCGdTdT | 1414 | CGGCCGUCCAUCUUGGACCdTdT | 1585 | GGUCCAAGAUGGACGGCCG | 1072 |
| AD-953603.1 | AUGGACGGCCGCUCAGGUUdTdT | 1415 | AACCUGAGCGGCCGUCCAUdTdT | 1586 | AUGGACGGCCGCUCAGGUU | 1073 |
| AD-953611.1 | CCGCUCAGGUUCUGCUUUUdTdT | 1416 | AAAAGCAGAACCUGAGCGGdTdT | 1587 | CCGCUCAGGUUCUGCUUUU | 1074 |
| AD-953619.1 | GUUCUGCUUUUACCUGCGGdTdT | 1417 | CCGCAGGUAAAAGCAGAACdTdT | 1588 | GUUCUGCUUUUACCUGCGG | 1075 |
| AD-953627.1 | UUUACCUGCGGCCCAGAGCdTdT | 1418 | GCUCUGGGCCGCAGGUAAAdTdT | 1589 | UUUACCUGCGGCCCAGAGC | 1076 |
| AD-953634.1 | GCGGCCCAGAGCCCCAUUCdTdT | 1419 | GAAUGGGGCUCUGGGCCGCdTdT | 1590 | GCGGCCCAGAGCCCCAUUC | 1077 |
| AD-953642.1 | GAGCCCCAUUCAUUGCCCCdTdT | 1420 | GGGGCAAUGAAUGGGGCUCdTdT | 1591 | GAGCCCCAUUCAUUGCCCC | 1078 |
| AD-953650.1 | UUCAUUGCCCCGGUGCUGAdTdT | 1421 | UCAGCACCGGGGCAAUGAAdTdT | 1592 | UUCAUUGCCCCGGUGCUGA | 1079 |
| AD-953658.1 | CCCGGUGCUGAGCGGCGCCdTdT | 1422 | GGCGCCGCUCAGCACCGGGdTdT | 1593 | CCCGGUGCUGAGCGGCGCC | 1080 |
| AD-953666.1 | UGAGCGGCGCCGCGAGUCGdTdT | 1423 | CGACUCGCGGCGCCGCUCAdTdT | 1594 | UGAGCGGCGCCGCGAGUCG | 1081 |
| AD-953674.1 | GCCGCGAGUCGGCCCGAGGdTdT | 1424 | CCUCGGGCCGACUCGCGGCdTdT | 1595 | GCCGCGAGUCGGCCCGAGG | 1082 |
| AD-953588.1 | CGGGACGGGUCCAAGAUGGdTdT | 1425 | CCAUCUUGGACCCGUCCCGdTdT | 1596 | CGGGACGGGUCCAAGAUGG | 1083 |
| AD-953596.1 | GUCCAAGAUGGACGGCCGCdTdT | 1426 | GCGGCCGUCCAUCUUGGACdTdT | 1597 | GUCCAAGAUGGACGGCCGC | 1084 |

TABLE 6-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-953604.1 | UGGACGGCCGCUCAGGUUCdTdT | 1427 | GAACCUGAGCGGCCGUCCAdTdT | 1598 | UGGACGGCCGCUCAGGUUC | 1085 |
| AD-953612.1 | CGCUCAGGUUCUGCUUUUAdTdT | 1428 | UAAAAGCAGAACCUGAGCGdTdT | 1599 | CGCUCAGGUUCUGCUUUUA | 1086 |
| AD-953620.1 | UUCUGCUUUUACCUGCGGCdTdT | 1429 | GCCGCAGGUAAAAGCAGAAdTdT | 1600 | UUCUGCUUUUACCUGCGGC | 1087 |
| AD-953628.1 | UUACCUGCGGCCCAGAGCCdTdT | 1430 | GGCUCUGGGCCGCAGGUAAdTdT | 1601 | UUACCUGCGGCCCAGAGCC | 1088 |
| AD-953635.1 | CGGCCCAGAGCCCCAUUCAdTdT | 1431 | UGAAUGGGGCUCUGGGCCGdTdT | 1602 | CGGCCCAGAGCCCCAUUCA | 1089 |
| AD-953643.1 | AGCCCCAUUCAUUGCCCCGdTdT | 1432 | CGGGGCAAUGAAUGGGGCUdTdT | 1603 | AGCCCCAUUCAUUGCCCCG | 1090 |
| AD-953651.1 | UCAUUGCCCCGGUGCUGAGdTdT | 1433 | CUCAGCACCGGGGCAAUGAdTdT | 1604 | UCAUUGCCCCGGUGCUGAG | 1091 |
| AD-953659.1 | CCGGUGCUGAGCGGCGCCGdTdT | 1434 | CGGCGCCGCUCAGCACCGGdTdT | 1605 | CCGGUGCUGAGCGGCGCCG | 1092 |
| AD-953667.1 | GAGCGGCGCCGCGAGUCGGdTdT | 1435 | CCGACUCGCGGCGCCGCUCdTdT | 1606 | GAGCGGCGCCGCGAGUCGG | 1093 |
| AD-953675.1 | CCGCGAGUCGGCCCGAGGCdTdT | 1436 | GCCUCGGGCCGACUCGCGGdTdT | 1607 | CCGCGAGUCGGCCCGAGGC | 1094 |
| AD-953589.1 | GGGACGGGUCCAAGAUGGAdTdT | 1437 | UCCAUCUUGGACCCGUCCCdTdT | 1608 | GGGACGGGUCCAAGAUGGA | 1095 |
| AD-953597.1 | UCCAAGAUGGACGGCCGCUdTdT | 1438 | AGCGGCCGUCCAUCUUGGAdTdT | 1609 | UCCAAGAUGGACGGCCGCU | 1096 |
| AD-953605.1 | GGACGGCCGCUCAGGUUCUdTdT | 1439 | AGAACCUGAGCGGCCGUCCdTdT | 1610 | GGACGGCCGCUCAGGUUCU | 1097 |
| AD-953613.1 | GCUCAGGUUCUGCUUUUACdTdT | 1440 | GUAAAAGCAGAACCUGAGCdTdT | 1611 | GCUCAGGUUCUGCUUUUAC | 1098 |
| AD-953621.1 | UCUGCUUUUACCUGCGGCCdTdT | 1441 | GGCCGCAGGUAAAAGCAGAdTdT | 1612 | UCUGCUUUUACCUGCGGCC | 1099 |
| AD-953629.1 | UACCUGCGGCCCAGAGCCCdTdT | 1442 | GGGCUCUGGGCCGCAGGUAdTdT | 1613 | UACCUGCGGCCCAGAGCCC | 1100 |
| AD-953636.1 | GGCCCAGAGCCCCAUUCAUdTdT | 1443 | AUGAAUGGGGCUCUGGGCCdTdT | 1614 | GGCCCAGAGCCCCAUUCAU | 1101 |
| AD-953644.1 | GCCCCAUUCAUUGCCCCGGdTdT | 1444 | CCGGGGCAAUGAAUGGGGCdTdT | 1615 | GCCCCAUUCAUUGCCCCGG | 1102 |
| AD-953652.1 | CAUUGCCCCGGUGCUGAGCdTdT | 1445 | GCUCAGCACCGGGGCAAUGdTdT | 1616 | CAUUGCCCCGGUGCUGAGC | 1103 |
| AD-953660.1 | CGGUGCUGAGCGGCGCCGCdTdT | 1446 | GCGGCGCCGCUCAGCACCGdTdT | 1617 | CGGUGCUGAGCGGCGCCGC | 1104 |
| AD-953676.1 | CGCGAGUCGGCCCGAGGCCdTdT | 1447 | GGCCUCGGGCCGACUCGCGdTdT | 1618 | CGCGAGUCGGCCCGAGGCC | 1105 |
| AD-953590.1 | GGACGGGUCCAAGAUGGACdTdT | 1448 | GUCCAUCUUGGACCCGUCCdTdT | 1619 | GGACGGGUCCAAGAUGGAC | 1106 |
| AD-953598.1 | CCAAGAUGGACGGCCGCUCdTdT | 1449 | GAGCGGCCGUCCAUCUUGGdTdT | 1620 | CCAAGAUGGACGGCCGCUC | 1107 |
| AD-953606.1 | GACGGCCGCUCAGGUUCUGdTdT | 1450 | CAGAACCUGAGCGGCCGUCdTdT | 1621 | GACGGCCGCUCAGGUUCUG | 1108 |
| AD-953614.1 | CUCAGGUUCUGCUUUUACCdTdT | 1451 | GGUAAAAGCAGAACCUGAGdTdT | 1622 | CUCAGGUUCUGCUUUUACC | 1109 |
| AD-953622.1 | CUGCUUUUACCUGCGGCCCdTdT | 1452 | GGGCCGCAGGUAAAAGCAGdTdT | 1623 | CUGCUUUUACCUGCGGCCC | 1110 |
| AD-953637.1 | GCCCAGAGCCCCAUUCAUUdTdT | 1453 | AAUGAAUGGGGCUCUGGGCdTdT | 1624 | GCCCAGAGCCCCAUUCAUU | 1111 |
| AD-953645.1 | CCCCAUUCAUUGCCCCGGUdTdT | 1454 | ACCGGGGCAAUGAAUGGGGdTdT | 1625 | CCCCAUUCAUUGCCCCGGU | 1112 |
| AD-953653.1 | AUUGCCCCGGUGCUGAGCGdTdT | 1455 | CGCUCAGCACCGGGGCAAUdTdT | 1626 | AUUGCCCCGGUGCUGAGCG | 1113 |
| AD-953661.1 | GGUGCUGAGCGGCGCCGCGdTdT | 1456 | CGCGGCGCCGCUCAGCACCdTdT | 1627 | GGUGCUGAGCGGCGCCGCG | 1114 |
| AD-953677.1 | GCGAGUCGGCCCGAGGCCUdTdT | 1457 | AGGCCUCGGGCCGACUCGCdTdT | 1628 | GCGAGUCGGCCCGAGGCCU | 1115 |
| AD-953685.1 | GCCCGAGGCCUCCGGGGACdTdT | 1458 | GUCCCCGGAGGCCUCGGGCdTdT | 1629 | GCCCGAGGCCUCCGGGGAC | 1116 |
| AD-953693.1 | CCUCCGGGGACUGCCGUGCdTdT | 1459 | GCACGGCAGUCCCCGGAGGdTdT | 1630 | CCUCCGGGGACUGCCGUGC | 1117 |
| AD-953701.1 | GACUGCCGUGCCGGGCGGGdTdT | 1460 | CCCGCCCGGCACGGCAGUCdTdT | 1631 | GACUGCCGUGCCGGGCGGG | 1118 |
| AD-953709.1 | UGCCGGGCGGGAGACCGCCdTdT | 1461 | GGCGGUCUCCCGCCCGGCAdTdT | 1632 | UGCCGGGCGGGAGACCGCC | 1119 |
| AD-953717.1 | GGGAGACCGCCAUGGCGACdTdT | 1462 | GUCGCCAUGGCGGUCUCCCdTdT | 1633 | GGGAGACCGCCAUGGCGAC | 1120 |
| AD-953724.1 | CGCCAUGGCGACCCUGGAAdTdT | 1463 | UUCCAGGGUCGCCAUGGCGdTdT | 1634 | CGCCAUGGCGACCCUGGAA | 1121 |

TABLE 6-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953732.1 | CGACCCUGGAAAAGCUGAUdTdT | 1464 | AUCAGCUUUUCCAGGGUCGdTdT | 1635 | CGACCCUGGAAAAGCUGAU | 1122 |
| AD-953702.1 | ACUGCCGUGCCGGGCGGGAdTdT | 1465 | UCCCGCCCGGCACGGCAGUdTdT | 1636 | ACUGCCGUGCCGGGCGGGA | 1123 |
| AD-953710.1 | GCCGGGCGGGAGACCGCCAdTdT | 1466 | UGGCGGUCUCCCGCCCGGCdTdT | 1637 | GCCGGGCGGGAGACCGCCA | 1124 |
| AD-953718.1 | GGAGACCGCCAUGGCGACCdTdT | 1467 | GGUCGCCAUGGCGGUCUCCdTdT | 1638 | GGAGACCGCCAUGGCGACC | 1125 |
| AD-953733.1 | GACCCUGGAAAAGCUGAUGdTdT | 1468 | CAUCAGCUUUUCCAGGGUCdTdT | 1639 | GACCCUGGAAAAGCUGAUG | 1126 |
| AD-953741.1 | AAAAGCUGAUGAAGGCCUUdTdT | 1469 | AAGGCCUUCAUCAGCUUUUdTdT | 1640 | AAAAGCUGAUGAAGGCCUU | 1127 |
| AD-953749.1 | AUGAAGGCCUUCGAGUCCCdTdT | 1470 | GGGACUCGAAGGCCUUCAUdTdT | 1641 | AUGAAGGCCUUCGAGUCCC | 1128 |
| AD-953757.1 | CUUCGAGUCCCUCAAGUCCdTdT | 1471 | GGACUUGAGGGACUCGAAGdTdT | 1642 | CUUCGAGUCCCUCAAGUCC | 1129 |
| AD-953679.1 | GAGUCGGCCCGAGGCCUCCdTdT | 1472 | GGAGGCCUCGGGCCGACUCdTdT | 1643 | GAGUCGGCCCGAGGCCUCC | 1130 |
| AD-953687.1 | CCGAGGCCUCCGGGGACUGdTdT | 1473 | CAGUCCCCGGAGGCCUCGGdTdT | 1644 | CCGAGGCCUCCGGGGACUG | 1131 |
| AD-953695.1 | UCCGGGGACUGCCGUGCCGdTdT | 1474 | CGGCACGGCAGUCCCCGGAdTdT | 1645 | UCCGGGGACUGCCGUGCCG | 1132 |
| AD-953703.1 | CUGCCGUGCCGGGCGGGAGdTdT | 1475 | CUCCCGCCCGGCACGGCAGdTdT | 1646 | CUGCCGUGCCGGGCGGGAG | 1133 |
| AD-953711.1 | CCGGGCGGGAGACCGCCAUdTdT | 1476 | AUGGCGGUCUCCCGCCCGGdTdT | 1647 | CCGGGCGGGAGACCGCCAU | 1134 |
| AD-953719.1 | GAGACCGCCAUGGCGACCCdTdT | 1477 | GGGUCGCCAUGGCGGUCUCdTdT | 1648 | GAGACCGCCAUGGCGACCC | 1135 |
| AD-953726.1 | CCAUGGCGACCCUGGAAAAdTdT | 1478 | UUUUCCAGGGUCGCCAUGGdTdT | 1649 | CCAUGGCGACCCUGGAAAA | 1136 |
| AD-953734.1 | ACCCUGGAAAAGCUGAUGAdTdT | 1479 | UCAUCAGCUUUUCCAGGGUdTdT | 1650 | ACCCUGGAAAAGCUGAUGA | 1137 |
| AD-953742.1 | AAAGCUGAUGAAGGCCUUCdTdT | 1480 | GAAGGCCUUCAUCAGCUUUdTdT | 1651 | AAAGCUGAUGAAGGCCUUC | 1138 |
| AD-953750.1 | UGAAGGCCUUCGAGUCCCUdTdT | 1481 | AGGGACUCGAAGGCCUUCAdTdT | 1652 | UGAAGGCCUUCGAGUCCCU | 1139 |
| AD-953758.1 | UUCGAGUCCCUCAAGUCCUdTdT | 1482 | AGGACUUGAGGGACUCGAAdTdT | 1653 | UUCGAGUCCCUCAAGUCCU | 1140 |
| AD-953680.1 | AGUCGGCCCGAGGCCUCCGdTdT | 1483 | CGGAGGCCUCGGGCCGACUdTdT | 1654 | AGUCGGCCCGAGGCCUCCG | 1141 |
| AD-953688.1 | CGAGGCCUCCGGGGACUGCdTdT | 1484 | GCAGUCCCCGGAGGCCUCGdTdT | 1655 | CGAGGCCUCCGGGGACUGC | 1142 |
| AD-953696.1 | CCGGGGACUGCCGUGCCGGdTdT | 1485 | CCGGCACGGCAGUCCCCGGdTdT | 1656 | CCGGGGACUGCCGUGCCGG | 1143 |
| AD-953704.1 | UGCCGUGCCGGGCGGGAGAdTdT | 1486 | UCUCCCGCCCGGCACGGCAdTdT | 1657 | UGCCGUGCCGGGCGGGAGA | 1144 |
| AD-953712.1 | CGGGCGGGAGACCGCCAUGdTdT | 1487 | CAUGGCGGUCUCCCGCCCGdTdT | 1658 | CGGGCGGGAGACCGCCAUG | 1145 |
| AD-953720.1 | AGACCGCCAUGGCGACCCUdTdT | 1488 | AGGGUCGCCAUGGCGGUCUdTdT | 1659 | AGACCGCCAUGGCGACCCU | 1146 |
| AD-953727.1 | CAUGGCGACCCUGGAAAAGdTdT | 1489 | CUUUUCCAGGGUCGCCAUGdTdT | 1660 | CAUGGCGACCCUGGAAAAG | 1147 |
| AD-953735.1 | CCCUGGAAAAGCUGAUGAAdTdT | 1490 | UUCAUCAGCUUUUCCAGGGdTdT | 1661 | CCCUGGAAAAGCUGAUGAA | 1148 |
| AD-953743.1 | AAGCUGAUGAAGGCCUUCGdTdT | 1491 | CGAAGGCCUUCAUCAGCUUdTdT | 1662 | AAGCUGAUGAAGGCCUUCG | 1149 |
| AD-953751.1 | GAAGGCCUUCGAGUCCCUCdTdT | 1492 | GAGGGACUCGAAGGCCUUCdTdT | 1663 | GAAGGCCUUCGAGUCCCUC | 1150 |
| AD-953759.1 | UCGAGUCCCUCAAGUCCUUdTdT | 1493 | AAGGACUUGAGGGACUCGAdTdT | 1664 | UCGAGUCCCUCAAGUCCUU | 1151 |
| AD-953681.1 | GUCGGCCCGAGGCCUCCGGdTdT | 1494 | CCGGAGGCCUCGGGCCGACdTdT | 1665 | GUCGGCCCGAGGCCUCCGG | 1152 |
| AD-953689.1 | GAGGCCUCCGGGGACUGCCdTdT | 1495 | GGCAGUCCCCGGAGGCCUCdTdT | 1666 | GAGGCCUCCGGGGACUGCC | 1153 |
| AD-953697.1 | CGGGGACUGCCGUGCCGGGdTdT | 1496 | CCCGGCACGGCAGUCCCCGdTdT | 1667 | CGGGGACUGCCGUGCCGGG | 1154 |
| AD-953705.1 | GCCGUGCCGGGCGGGAGACdTdT | 1497 | GUCUCCCGCCCGGCACGGCdTdT | 1668 | GCCGUGCCGGGCGGGAGAC | 1155 |
| AD-953713.1 | GGGCGGGAGACCGCCAUGGdTdT | 1498 | CCAUGGCGGUCUCCCGCCCdTdT | 1669 | GGGCGGGAGACCGCCAUGG | 1156 |
| AD-953721.1 | GACCGCCAUGGCGACCCUGdTdT | 1499 | CAGGGUCGCCAUGGCGGUCdTdT | 1670 | GACCGCCAUGGCGACCCUG | 1157 |
| AD-953728.1 | AUGGCGACCCUGGAAAAGCdTdT | 1500 | GCUUUUCCAGGGUCGCCAUdTdT | 1671 | AUGGCGACCCUGGAAAAGC | 1158 |

TABLE 6-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-953736.1 | CCUGGAAAAGCUGAUGAAGdTdT | 1501 | CUUCAUCAGCUUUUCCAGGdTdT | 1672 | CCUGGAAAAGCUGAUGAAG | 1159 |
| AD-953744.1 | AGCUGAUGAAGGCCUUCGAdTdT | 1502 | UCGAAGGCCUUCAUCAGCUdTdT | 1673 | AGCUGAUGAAGGCCUUCGA | 1160 |
| AD-953752.1 | AAGGCCUUCGAGUCCCUCAdTdT | 1503 | UGAGGGACUCGAAGGCCUUdTdT | 1674 | AAGGCCUUCGAGUCCCUCA | 1161 |
| AD-953760.1 | CGAGUCCCUCAAGUCCUUCdTdT | 1504 | GAAGGACUUGAGGGACUCGdTdT | 1675 | CGAGUCCCUCAAGUCCUUC | 1162 |
| AD-953682.1 | UCGGCCCGAGGCCUCCGGGdTdT | 1505 | CCCGGAGGCCUCGGGCCGAdTdT | 1676 | UCGGCCCGAGGCCUCCGGG | 1163 |
| AD-953690.1 | AGGCCUCCGGGGACUGCCGdTdT | 1506 | CGGCAGUCCCCGGAGGCCUdTdT | 1677 | AGGCCUCCGGGGACUGCCG | 1164 |
| AD-953698.1 | GGGGACUGCCGUGCCGGGCdTdT | 1507 | GCCCGGCACGGCAGUCCCCdTdT | 1678 | GGGGACUGCCGUGCCGGGC | 1165 |
| AD-953706.1 | CCGUGCCGGGCGGGAGACCdTdT | 1508 | GGUCUCCCGCCCGGCACGGdTdT | 1679 | CCGUGCCGGGCGGGAGACC | 1166 |
| AD-953714.1 | GGCGGGAGACCGCCAUGGCdTdT | 1509 | GCCAUGGCGGUCUCCCGCCdTdT | 1680 | GGCGGGAGACCGCCAUGGC | 1167 |
| AD-953722.1 | ACCGCCAUGGCGACCCUGGdTdT | 1510 | CCAGGGUCGCCAUGGCGGUdTdT | 1681 | ACCGCCAUGGCGACCCUGG | 1168 |
| AD-953729.1 | UGGCGACCCUGGAAAAGCUdTdT | 1511 | AGCUUUUCCAGGGUCGCCAdTdT | 1682 | UGGCGACCCUGGAAAAGCU | 1169 |
| AD-953737.1 | CUGGAAAAGCUGAUGAAGGdTdT | 1512 | CCUUCAUCAGCUUUUCCAGdTdT | 1683 | CUGGAAAAGCUGAUGAAGG | 1170 |
| AD-953745.1 | GCUGAUGAAGGCCUUCGAGdTdT | 1513 | CUCGAAGGCCUUCAUCAGCdTdT | 1684 | GCUGAUGAAGGCCUUCGAG | 1171 |
| AD-953753.1 | AGGCCUUCGAGUCCCUCAAdTdT | 1514 | UUGAGGGACUCGAAGGCCUdTdT | 1685 | AGGCCUUCGAGUCCCUCAA | 1172 |
| AD-953761.1 | GAGUCCCUCAAGUCCUUCCdTdT | 1515 | GGAAGGACUUGAGGGACUCdTdT | 1686 | GAGUCCCUCAAGUCCUUCC | 1173 |
| AD-953683.1 | CGGCCCGAGGCCUCCGGGGdTdT | 1516 | CCCCGGAGGCCUCGGGCCGdTdT | 1687 | CGGCCCGAGGCCUCCGGGG | 1174 |
| AD-953691.1 | GGCCUCCGGGGACUGCCGUdTdT | 1517 | ACGGCAGUCCCCGGAGGCCdTdT | 1688 | GGCCUCCGGGGACUGCCGU | 1175 |
| AD-953699.1 | GGGACUGCCGUGCCGGGCGdTdT | 1518 | CGCCCGGCACGGCAGUCCCdTdT | 1689 | GGGACUGCCGUGCCGGGCG | 1176 |
| AD-953707.1 | CGUGCCGGGCGGGAGACCGdTdT | 1519 | CGGUCUCCCGCCCGGCACGdTdT | 1690 | CGUGCCGGGCGGGAGACCG | 1177 |
| AD-953715.1 | GCGGGAGACCGCCAUGGCGdTdT | 1520 | CGCCAUGGCGGUCUCCCGCdTdT | 1691 | GCGGGAGACCGCCAUGGCG | 1178 |
| AD-953723.1 | CCGCCAUGGCGACCCUGGAdTdT | 1521 | UCCAGGGUCGCCAUGGCGGdTdT | 1692 | CCGCCAUGGCGACCCUGGA | 1179 |
| AD-953730.1 | GGCGACCCUGGAAAAGCUGdTdT | 1522 | CAGCUUUUCCAGGGUCGCCdTdT | 1693 | GGCGACCCUGGAAAAGCUG | 1180 |
| AD-953738.1 | UGGAAAAGCUGAUGAAGGCdTdT | 1523 | GCCUUCAUCAGCUUUUCCAdTdT | 1694 | UGGAAAAGCUGAUGAAGGC | 1181 |
| AD-953746.1 | CUGAUGAAGGCCUUCGAGUdTdT | 1524 | ACUCGAAGGCCUUCAUCAGdTdT | 1695 | CUGAUGAAGGCCUUCGAGU | 1182 |
| AD-953754.1 | GGCCUUCGAGUCCCUCAAGdTdT | 1525 | CUUGAGGGACUCGAAGGCCdTdT | 1696 | GGCCUUCGAGUCCCUCAAG | 1183 |
| AD-953762.1 | AGUCCCUCAAGUCCUUCCAdTdT | 1526 | UGGAAGGACUUGAGGGACUdTdT | 1697 | AGUCCCUCAAGUCCUUCCA | 1184 |
| AD-953684.1 | GGCCCGAGGCCUCCGGGGAdTdT | 1527 | UCCCCGGAGGCCUCGGGCCdTdT | 1698 | GGCCCGAGGCCUCCGGGGA | 1185 |
| AD-953692.1 | GCCUCCGGGGACUGCCGUGdTdT | 1528 | CACGGCAGUCCCCGGAGGCdTdT | 1699 | GCCUCCGGGGACUGCCGUG | 1186 |
| AD-953700.1 | GGACUGCCGUGCCGGGCGGdTdT | 1529 | CCGCCCGGCACGGCAGUCCdTdT | 1700 | GGACUGCCGUGCCGGGCGG | 1187 |
| AD-953708.1 | GUGCCGGGCGGGAGACCGCdTdT | 1530 | GCGGUCUCCCGCCCGGCACdTdT | 1701 | GUGCCGGGCGGGAGACCGC | 1188 |
| AD-953716.1 | CGGGAGACCGCCAUGGCGAdTdT | 1531 | UCGCCAUGGCGGUCUCCCGdTdT | 1702 | CGGGAGACCGCCAUGGCGA | 1189 |
| AD-953731.1 | GCGACCCUGGAAAAGCUGAdTdT | 1532 | UCAGCUUUUCCAGGGUCGCdTdT | 1703 | GCGACCCUGGAAAAGCUGA | 1190 |
| AD-953739.1 | GGAAAAGCUGAUGAAGGCCdTdT | 1533 | GGCCUUCAUCAGCUUUUCCdTdT | 1704 | GGAAAAGCUGAUGAAGGCC | 1191 |
| AD-953747.1 | UGAUGAAGGCCUUCGAGUCdTdT | 1534 | GACUCGAAGGCCUUCAUCAdTdT | 1705 | UGAUGAAGGCCUUCGAGUC | 1192 |
| AD-953755.1 | GCCUUCGAGUCCCUCAAGUdTdT | 1535 | ACUUGAGGGACUCGAAGGCdTdT | 1706 | GCCUUCGAGUCCCUCAAGU | 1193 |

TABLE 8

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953857.1 | UCAUAAUCACAUUCGUUUGUA | 1707 | 4405-4425 | UACAAACGAAUGUGAUUAUGAAU | 1867 | 4403-4425 |
| AD-953865.1 | UUCAGUUACGGGUUAAUUACA | 1708 | 4518-4538 | UGUAAUUAACCCGUAACUGAACC | 1868 | 4516-4538 |
| AD-953873.1 | ACUGUCUCGACAGAUAGCUGA | 1709 | 4966-4986 | UCAGCUAUCUGUCGAGACAGUCG | 1869 | 4964-4986 |
| AD-953881.1 | UUACGGAGUAUGUUCGUCACA | 1710 | 5108-5128 | UGUGACGAACAUACUCCGUAAAA | 1870 | 5106-5128 |
| AD-953889.1 | GCAACAUACUUUCUAUUGCCA | 187 | 5452-5472 | UGGCAAUAGAAAGUAUGUUGCUG | 1871 | 5450-5472 |
| AD-953897.1 | ACUCCGAGCACUUAACGUGGA | 1711 | 5886-5906 | UCCACGUUAAGUGCUCGGAGUCA | 1872 | 5884-5906 |
| AD-953904.1 | GCAAUUCAGUCUCGUUGUGAA | 1712 | 6017-6037 | UUCACAACGAGACUGAAUUGCCU | 1873 | 6015-6037 |
| AD-953912.1 | UGCCUUCAUGAUGAACUCGGA | 1713 | 6547-6567 | UCCGAGUUCAUCAUGAAGGCAUU | 1874 | 6545-6567 |
| AD-953920.1 | CAACAGCUACACACGUGUGCA | 1714 | 7366-7386 | UGCACACGUGUGUAGCUGUUGAC | 1875 | 7364-7386 |
| AD-953928.1 | GACGCUGACAGAACUGCGAAA | 1715 | 8317-8337 | UUUCGCAGUUCUGUCAGCGUCAC | 1876 | 8315-8337 |
| AD-953936.1 | CUGACUUGUUUACGAAAUGUA | 1716 | 9539-9559 | UACAUUUCGUAAACAAGUCAGCA | 1877 | 9537-9559 |
| AD-953858.1 | AUCACAUUCGUUUGUUUGAAA | 1717 | 4410-4430 | UUUCAAACAAACGAAUGUGAUUA | 1878 | 4408-4430 |
| AD-953866.1 | CAGUUACGGGUUAAUUACUGA | 1718 | 4520-4540 | UCAGUAAUUAACCCGUAACUGAA | 1879 | 4518-4540 |
| AD-953874.1 | AAGCCCUUGGAGUGUUAAAUA | 1719 | 5037-5057 | UAUUUAACACUCCAAGGGCUUCA | 1880 | 5035-5057 |
| AD-953882.1 | UCUGAUUUCCCAGUCAACUGA | 1720 | 5197-5217 | UCAGUUGACUGGGAAAUCAGAAC | 1881 | 5195-5217 |
| AD-953890.1 | AUCUUCAAGUCUGGAAUGUUA | 1721 | 5507-5527 | UAACAUUCCAGACUUGAAGAUGU | 1882 | 5505-5527 |
| AD-953898.1 | AUCCAGGCAAUUCAGUCUCGA | 1722 | 6011-6031 | UCGAGACUGAAUUGCCUGGAUGA | 1883 | 6009-6031 |
| AD-953905.1 | AUGGUCGACAUCCUUGCUUGA | 1723 | 6170-6190 | UCAAGCAAGGAUGUCGACCAUGC | 1884 | 6168-6190 |
| AD-953913.1 | CUUCAUGAUGAACUCGGAGUA | 1724 | 6550-6570 | UACUCCGAGUUCAUCAUGAAGGC | 1885 | 6548-6570 |
| AD-953921.1 | GACCAGUCGUACUCAGUUUGA | 1725 | 7525-7545 | UCAAACUGAGUACGACUGGUCCA | 1886 | 7523-7545 |
| AD-953929.1 | ACGCUGACAGAACUGCGAAGA | 1726 | 8318-8338 | UCUUCGCAGUUCUGUCAGCGUCA | 1887 | 8316-8338 |
| AD-953937.1 | UGACUUGUUUACGAAAUGUCA | 1727 | 9540-9560 | UGACAUUUCGUAAACAAGUCAGC | 1888 | 9538-9560 |
| AD-953859.1 | UGUUUGAACCUCUUGUUAUAA | 127 | 4422-4442 | UUAUAACAAGAGGUUCAAACAAA | 328 | 4420-4442 |
| AD-953867.1 | UCAGAUCAGGUGUUUAUUGGA | 1728 | 4550-4570 | UCCAAUAAACACCUGAUCUGAAU | 1889 | 4548-4570 |
| AD-953875.1 | GCCCUUGGAGUGUUAAAUACA | 1729 | 5039-5059 | UGUAUUUAACACUCCAAGGGCUU | 1890 | 5037-5059 |
| AD-953883.1 | AAGAUAUUGUUCUUUCUCGUA | 113 | 5217-5237 | UACGAGAAAGAACAAUAUCUUCA | 314 | 5215-5237 |
| AD-953891.1 | UCAAGUCUGGAAUGUUCCGGA | 1730 | 5511-5531 | UCCGGAACAUUCCAGACUUGAAG | 1891 | 5509-5531 |
| AD-953899.1 | UCCAGGCAAUUCAGUCUCGUA | 1731 | 6012-6032 | UACGAGACUGAAUUGCCUGGAUG | 1892 | 6010-6032 |
| AD-953906.1 | GUCGACAUCCUUGCUUGUCGA | 1732 | 6173-6193 | UCGACAAGCAAGGAUGUCGACCA | 1893 | 6171-6193 |
| AD-953914.1 | CUGCUAGCUCCAUGCUUAAGA | 1733 | 6581-6601 | UCUUAAGCAUGGAGCUAGCAGGC | 1894 | 6579-6601 |
| AD-953922.1 | ACCAGUCGUACUCAGUUUGAA | 1734 | 7526-7546 | UUCAAACUGAGUACGACUGGUCC | 1895 | 7524-7546 |
| AD-953930.1 | GAAAGGAGAAAGUCAGUCCGA | 1735 | 8937-8957 | UCGGACUGACUUUCUCCUUUCCU | 1896 | 8935-8957 |
| AD-953938.1 | UAACGUAACUCUUUCUAUGCA | 1736 | 10173-10193 | UGCAUAGAAAGAGUUACGUUAAA | 1897 | 10171-10193 |
| AD-953860.1 | GUUUGAACCUCUUGUUAUAAA | 123 | 4423-4443 | UUUAUAACAAGAGGUUCAAACAA | 324 | 4421-4443 |
| AD-953868.1 | UUGGCUUUGUAUUGAAACAGA | 1737 | 4566-4586 | UCUGUUUCAAUACAAAGCCAAUA | 1898 | 4564-4586 |
| AD-953876.1 | UAGACAUGCUUUUACGGAGUA | 1738 | 5097-5117 | UACUCCGUAAAAGCAUGUCUACC | 1899 | 5095-5117 |
| AD-953884.1 | GAUAUUGUUCUUUCUCGUAUA | 1739 | 5219-5239 | UAUACGAGAAAGAACAAUAUCUU | 1900 | 5217-5239 |

TABLE 8-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953892.1 | CAAGUCUGGAAUGUUCCGGAA | 1740 | 5512-5532 | UUCCGGAACAUUCCAGACUUGAA | 1901 | 5510-5532 |
| AD-953900.1 | CCAGGCAAUUCAGUCUCGUUA | 1741 | 6013-6033 | UAACGAGACUGAAUUGCCUGGAU | 1902 | 6011-6033 |
| AD-953907.1 | CAUGCAAGACUCACUUAGUCA | 1742 | 6349-6369 | UGACUAAGUGAGUCUUGCAUGGU | 1903 | 6347-6369 |
| AD-953915.1 | UGCUAGCUCCAUGCUUAAGCA | 1743 | 6582-6602 | UGCUUAAGCAUGGAGCUAGCAGG | 1904 | 6580-6602 |
| AD-953923.1 | CCAGUCGUACUCAGUUUGAAA | 1744 | 7527-7547 | UUUCAAACUGAGUACGACUGGUC | 1905 | 7525-7547 |
| AD-953931.1 | AGAACUUCAGACCCUAAUCCA | 1745 | 8960-8980 | UGGAUUAGGGUCUGAAGUUCUAC | 1906 | 8958-8980 |
| AD-953939.1 | UCUAUGCCCGUGUAAAGUAUA | 1746 | 10186-10206 | UAUACUUUACACGGGCAUAGAAA | 1907 | 10184-10206 |
| AD-953861.1 | UUUGAACCUCUUGUUAUAAAA | 122 | 4424-4444 | UUUUAUAACAAGAGGUUCAAACA | 323 | 4422-4444 |
| AD-953869.1 | UUAUGAACGCUAUCAUUCAAA | 1747 | 4666-4686 | UUUGAAUGAUAGCGUUCAUAAGA | 1908 | 4664-4686 |
| AD-953877.1 | ACAUGCUUUUACGGAGUAUGA | 1748 | 5100-5120 | UCAUACUCCGUAAAAGCAUGUCU | 1909 | 5098-5120 |
| AD-953885.1 | UUGUUCUUUCUCGUAUUCAGA | 1749 | 5223-5243 | UCUGAAUACGAGAAAGAACAAUA | 1910 | 5221-5243 |
| AD-953893.1 | AGCACAAAGUUACUUAGUCCA | 1750 | 5744-5764 | UGGACUAAGUAACUUUGUGCUGG | 1911 | 5742-5764 |
| AD-953901.1 | CAGGCAAUUCAGUCUCGUUGA | 1751 | 6014-6034 | UCAACGAGACUGAAUUGCCUGGA | 1912 | 6012-6034 |
| AD-953908.1 | AUGCAAGACUCACUUAGUCCA | 1752 | 6350-6370 | UGGACUAAGUGAGUCUUGCAUGG | 1913 | 6348-6370 |
| AD-953916.1 | ACUGGAGCAAGUUGAAUGAUA | 1753 | 6753-6773 | UAUCAUUCAACUUGCUCCAGUAG | 1914 | 6751-6773 |
| AD-953924.1 | CAGUCGUACUCAGUUUGAAGA | 120 | 7528-7548 | UCUUCAAACUGAGUACGACUGGU | 321 | 7526-7548 |
| AD-953932.1 | UCAUGAACAAAGUCAUCGGAA | 1754 | 9129-9149 | UUCCGAUGACUUUGUUCAUGAUG | 1915 | 9127-9149 |
| AD-953940.1 | CUAUGCCCGUGUAAAGUAUGA | 1755 | 10187-10207 | UCAUACUUUACACGGGCAUAGAA | 1916 | 10185-10207 |
| AD-953862.1 | AAGCUUUAAAACAGUACACGA | 1756 | 4443-4463 | UCGUGUACUGUUUUAAAGCUUUU | 1917 | 4441-4463 |
| AD-953870.1 | AACGCUAUCAUUCAAAACAGA | 1757 | 4671-4691 | UCUGUUUUGAAUGAUAGCGUUCA | 1918 | 4669-4691 |
| AD-953878.1 | CUUUUACGGAGUAUGUUCGUA | 1758 | 5105-5125 | UACGAACAUACUCCGUAAAAGCA | 1919 | 5103-5125 |
| AD-953886.1 | UGUUCUUUCUCGUAUUCAGGA | 125 | 5224-5244 | UCCUGAAUACGAGAAAGAACAAU | 326 | 5222-5244 |
| AD-953894.1 | AGAGGAGGAUUCUGACUUGGA | 1759 | 5779-5799 | UCCAAGUCAGAAUCCUCCUCUUC | 1920 | 5777-5799 |
| AD-953902.1 | AGGCAAUUCAGUCUCGUUGUA | 1760 | 6015-6035 | UACAACGAGACUGAAUUGCCUGG | 1921 | 6013-6035 |
| AD-953909.1 | CACUGGAAACAGUGAGUCCGA | 1761 | 6417-6437 | UCGGACUCACUGUUUCCAGUGAC | 1922 | 6415-6437 |
| AD-953917.1 | UGUCAACAGCUACACACGUGA | 1762 | 7363-7383 | UCACGUGUGUAGCUGUUGACAAG | 1923 | 7361-7383 |
| AD-953925.1 | AAGCUGAGCAUUAUCAGAGGA | 1763 | 7787-7807 | UCCUCUGAUAAUGCUCAGCUUCC | 1924 | 7785-7807 |
| AD-953933.1 | CGGCUGCUGACUUGUUUACGA | 1764 | 9533-9553 | UCGUAAACAAGUCAGCAGCCGGU | 1925 | 9531-9553 |
| AD-953941.1 | CCGCUGACAUUUCCGUUGUAA | 1765 | 10311-10331 | UUACAACGGAAAUGUCAGCGGGU | 1926 | 10309-10331 |
| AD-953863.1 | AGCUGGUUCAGUUACGGGUUA | 1766 | 4512-4532 | UAACCCGUAACUGAACCAGCUGC | 1927 | 4510-4532 |
| AD-953871.1 | GUGGAAGCGACUGUCUCGACA | 1767 | 4957-4977 | UGUCGAGACAGUCGCUUCCACUU | 1928 | 4955-4977 |
| AD-953879.1 | UUUUACGGAGUAUGUUCGUCA | 1768 | 5106-5126 | UGACGAACAUACUCCGUAAAAGC | 1929 | 5104-5126 |
| AD-953887.1 | AUUUUCAAGGUUUCUAUUACA | 137 | 5368-5388 | UGUAAUAGAAACCUUGAAAAUGU | 338 | 5366-5388 |
| AD-953895.1 | CAAUAGAGAAAUAGUACGAAA | 1769 | 5818-5838 | UUUCGUACUAUUUCUCUAUUGCA | 1930 | 5816-5838 |
| AD-953903.1 | GGCAAUUCAGUCUCGUUGUGA | 1770 | 6016-6036 | UCACAACGAGACUGAAUUGCCUG | 1931 | 6014-6036 |
| AD-953910.1 | AGCUGGUGAAUCGGAUUCCUA | 1771 | 6513-6533 | UAGGAAUCCGAUUCACCAGCUCU | 1932 | 6511-6533 |
| AD-953918.1 | GUCAACAGCUACACACGUGUA | 1772 | 7364-7384 | UACACGUGUGUAGCUGUUGACAA | 1933 | 7362-7384 |

TABLE 8-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953926.1 | UUGAGCUGAUGUAUGUGACGA | 1773 | 8301-8321 | UCGUCACAUACAUCAGCUCAAAC | 1934 | 8299-8321 |
| AD-953934.1 | GGCUGCUGACUUGUUUACGAA | 1774 | 9534-9554 | UUCGUAAACAAGUCAGCAGCCGG | 1935 | 9532-9554 |
| AD-953864.1 | GUUCAGUUACGGGUUAAUUAA | 1775 | 4517-4537 | UUAAUUAACCCGUAACUGAACCA | 1936 | 4515-4537 |
| AD-953872.1 | GACUGUCUCGACAGAUAGCUA | 1776 | 4965-4985 | UAGCUAUCUGUCGAGACAGUCGC | 1937 | 4963-4985 |
| AD-953880.1 | UUUACGGAGUAUGUUCGUCAA | 1777 | 5107-5127 | UUGACGAACAUACUCCGUAAAAG | 1938 | 5105-5127 |
| AD-953888.1 | AAGGUUUCUAUUACAACUGGA | 1778 | 5374-5394 | UCCAGUUGUAAUAGAAACCUUGA | 1939 | 5372-5394 |
| AD-953896.1 | GACUCCGAGCACUUAACGUGA | 1779 | 5885-5905 | UCACGUUAAGUGCUCGGAGUCAU | 1940 | 5883-5905 |
| AD-953911.1 | GCUGGUGAAUCGGAUUCCUGA | 1780 | 6514-6534 | UCAGGAAUCCGAUUCACCAGCUC | 1941 | 6512-6534 |
| AD-953919.1 | UCAACAGCUACACACGUGUGA | 1781 | 7365-7385 | UCACACGUGUGUAGCUGUUGACA | 1942 | 7363-7385 |
| AD-953927.1 | GAGCUGAUGUAUGUGACGCUA | 1782 | 8303-8323 | UAGCGUCACAUACAUCAGCUCAA | 1943 | 8301-8323 |
| AD-953935.1 | CUGCUGACUUGUUUACGAAAA | 1783 | 9536-9556 | UUUUCGUAAACAAGUCAGCAGCC | 1944 | 9534-9556 |
| AD-953763.1 | AGCUACCAAGAAAGACCGUGA | 1784 | 430-450 | UCACGGUCUUUCUUGGUAGCUGA | 1945 | 428-450 |
| AD-953771.1 | AUUCUAAUCUUCCAAGGUUAA | 1785 | 630-650 | UUAACCUUGGAAGAUUAGAAUCC | 1946 | 628-650 |
| AD-953779.1 | AGGUUUAUGAACUGACGUUAA | 1786 | 1218-1238 | UUAACGUCAGUUCAUAAACCUGG | 1947 | 1216-1238 |
| AD-953787.1 | AGUAUUGUGGAACUUAUAGCA | 1787 | 1406-1426 | UGCUAUAAGUUCCACAAUACUCC | 1948 | 1404-1426 |
| AD-953795.1 | GACUCUGAAUCGAGAUCGGAA | 1788 | 1511-1531 | UUCCGAUCUCGAUUCAGAGUCAU | 1949 | 1509-1531 |
| AD-953803.1 | ACAGCAGUGUUGAUAAAUUUA | 1789 | 2073-2093 | UAAAUUUAUCAACACUGCUGUCA | 1950 | 2071-2093 |
| AD-953810.1 | CGCCUUUUAUCUGCUUCGUUA | 1790 | 2207-2227 | UAACGAAGCAGAUAAAAGGCGGA | 1951 | 2205-2227 |
| AD-953818.1 | CUGAGGAACAGUUCCUAUUGA | 1791 | 2717-2737 | UCAAUAGGAACUGUUCCUCAGAG | 1952 | 2715-2737 |
| AD-953834.1 | UAGGAAGAGCUGUACCGUUGA | 1792 | 3325-3345 | UCAACGGUACAGCUCUUCCUAGA | 1953 | 3323-3345 |
| AD-953842.1 | UUCUCUAAGUCCCAUCCGACA | 1793 | 3679-3699 | UGUCGGAUGGGACUUAGAGAAGG | 1954 | 3677-3699 |
| AD-953764.1 | CUACCAAGAAAGACCGUGUGA | 1794 | 432-452 | UCACACGGUCUUUCUUGGUAGCU | 1955 | 430-452 |
| AD-953772.1 | UUCCAAGGUUACAGCUCGAGA | 1795 | 639-659 | UCUCGAGCUGUAACCUUGGAAGA | 1956 | 637-659 |
| AD-953780.1 | GGUUUAUGAACUGACGUUACA | 1796 | 1219-1239 | UGUAACGUCAGUUCAUAAACCUG | 1957 | 1217-1239 |
| AD-953788.1 | GUAUUGUGGAACUUAUAGCUA | 1797 | 1407-1427 | UAGCUAUAAGUUCCACAAUACUC | 1958 | 1405-1427 |
| AD-953796.1 | ACUCUGAAUCGAGAUCGGAUA | 1798 | 1512-1532 | UAUCCGAUCUCGAUUCAGAGUCA | 1959 | 1510-1532 |
| AD-953804.1 | UGAUAAAUUUGUGUUGAGAGA | 1799 | 2083-2103 | UCUCUCAACACAAAUUUAUCAAC | 1960 | 2081-2103 |
| AD-953811.1 | UCUAUAAAGUUCCUCUUGACA | 181 | 2352-2372 | UGUCAAGAGGAACUUUAUAGAGU | 382 | 2350-2372 |
| AD-953819.1 | UGAGGAACAGUUCCUAUUGGA | 1800 | 2718-2738 | UCCAAUAGGAACUGUUCCUCAGA | 1961 | 2716-2738 |
| AD-953827.1 | UCUCCGUCAGCACAAUAACCA | 1801 | 3075-3095 | UGGUUAUUGUGCUGACGGAGAAA | 1962 | 3073-3095 |
| AD-953835.1 | AGGAAGAGCUGUACCGUUGGA | 1802 | 3326-3346 | UCCAACGGUACAGCUCUUCCUAG | 1963 | 3324-3346 |
| AD-953843.1 | GAGAACAAGCAUCUGUACCGA | 1803 | 3723-3743 | UCGGUACAGAUGCUUGUUCUCCU | 1964 | 3721-3743 |
| AD-953851.1 | GAGUGUCACAAAGAACCGUGA | 1804 | 4369-4389 | UCACGGUUCUUUGUGACACUCGU | 1965 | 4367-4389 |
| AD-953765.1 | AAUCAUUGUCUGACAAUAUGA | 1805 | 452-472 | UCAUAUUGUCAGACAAUGAUUCA | 1966 | 450-472 |
| AD-953773.1 | UCCAAGGUUACAGCUCGAGCA | 1806 | 640-660 | UGCUCGAGCUGUAACCUUGGAAG | 1967 | 638-660 |
| AD-953781.1 | UUUAUGAACUGACGUUACAUA | 1807 | 1221-1241 | UAUGUAACGUCAGUUCAUAAACC | 1968 | 1219-1241 |
| AD-953789.1 | UAUUGUGGAACUUAUAGCUGA | 1808 | 1408-1428 | UCAGCUAUAAGUUCCACAAUACU | 1969 | 1406-1428 |

TABLE 8-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953797.1 | CUCUGAAUCGAGAUCGGAUGA | 1809 | 1513-1533 | UCAUCCGAUCUCGAUUCAGAGUC | 1970 | 1511-1533 |
| AD-953805.1 | AGAUGAAGCUACUGAACCGGA | 1810 | 2101-2121 | UCCGGUUCAGUAGCUUCAUCUCU | 1971 | 2099-2121 |
| AD-953812.1 | CAUCUUGAACUACAUCGAUCA | 1811 | 2407-2427 | UGAUCGAUGUAGUUCAAGAUGUC | 1972 | 2405-2427 |
| AD-953828.1 | UCCGUCAGCACAAUAACCAGA | 1812 | 3077-3097 | UCUGGUUAUUGUGCUGACGGAGA | 1973 | 3075-3097 |
| AD-953836.1 | GGAAGAGCUGUACCGUUGGGA | 1813 | 3327-3347 | UCCCAACGGUACAGCUCUUCCUA | 1974 | 3325-3347 |
| AD-953852.1 | UGUCACAAAGAACCGUGCAGA | 1814 | 4372-4392 | UCUGCACGGUUCUUUGUGACACU | 1975 | 4370-4392 |
| AD-953766.1 | CAUUGUCUGACAAUAUGUGAA | 119 | 455-475 | UUCACAUAUUGUCAGACAAUGAU | 1976 | 453-475 |
| AD-953774.1 | CUGUUCCCAAAAUUAUGGCUA | 1815 | 843-863 | UAGCCAUAAUUUUGGGAACAGCU | 1977 | 841-863 |
| AD-953782.1 | CAGCACCAAGACCACAAUGUA | 1816 | 1247-1267 | UACAUUGUGGUCUUGGUGCUGUG | 1978 | 1245-1267 |
| AD-953790.1 | AUUGUGGAACUUAUAGCUGGA | 1817 | 1409-1429 | UCCAGCUAUAAGUUCCACAAUAC | 1979 | 1407-1429 |
| AD-953798.1 | UUCUGAAAUUGUGUUAGACGA | 1818 | 1885-1905 | UCGUCUAACACAAUUUCAGAACU | 1980 | 1883-1905 |
| AD-953806.1 | CCUCUUGUCCAUUGUGUCCGA | 1819 | 2189-2209 | UCGGACACAAUGGACAAGAGGUG | 1981 | 2187-2209 |
| AD-953813.1 | CUUGAACUACAUCGAUCAUGA | 1820 | 2410-2430 | UCAUGAUCGAUGUAGUUCAAGAU | 1982 | 2408-2430 |
| AD-953821.1 | AAGAACGAGUGCUCAAUAAUA | 1821 | 2862-2882 | UAUUAUUGAGCACUCGUUCUUGC | 1983 | 2860-2882 |
| AD-953829.1 | AACCUUUCAAGAGUUAUUGCA | 1822 | 3152-3172 | UGCAAUAACUCUUGAAAGGUUAU | 1984 | 3150-3172 |
| AD-953837.1 | GUCAGCUUGGUUCCCAUUGGA | 1823 | 3376-3396 | UCCAAUGGGAACCAAGCUGACGA | 1985 | 3374-3396 |
| AD-953845.1 | CCUGAAAUCCUGCUUUAGUCA | 1824 | 4039-4059 | UGACUAAAGCAGGAUUUCAGGUA | 1986 | 4037-4059 |
| AD-953853.1 | UAAGAAUGCUAUUCAUAAUCA | 1825 | 4393-4413 | UGAUUAUGAAUAGCAUUCUUAUC | 1987 | 4391-4413 |
| AD-953767.1 | AAUGCCUCAACAAAGUUAUCA | 1826 | 597-617 | UGAUAACUUUGUUGAGGCAUUCG | 1988 | 595-617 |
| AD-953775.1 | AGGCCUUCAUAGCGAACCUGA | 1827 | 909-929 | UCAGGUUCGCUAUGAAGGCCUUU | 1989 | 907-929 |
| AD-953783.1 | GCACCAAGACCACAAUGUUGA | 1828 | 1249-1269 | UCAACAUUGUGGUCUUGGUGCUG | 1990 | 1247-1269 |
| AD-953791.1 | UGGAGGAUGACUCUGAAUCGA | 1829 | 1503-1523 | UCGAUUCAGAGUCAUCCUCCAAG | 1991 | 1501-1523 |
| AD-953799.1 | UCUGAAAUUGUGUUAGACGGA | 1830 | 1886-1906 | UCCGUCUAACACAAUUUCAGAAC | 1992 | 1884-1906 |
| AD-953807.1 | CUCUUGUCCAUUGUGUCCGCA | 1831 | 2190-2210 | UGCGGACACAAUGGACAAGAGGU | 1993 | 2188-2210 |
| AD-953822.1 | GAGUGCUCAAUAAUGUUGUCA | 1832 | 2868-2888 | UGACAACAUUAUUGAGCACUCGU | 1994 | 2866-2888 |
| AD-953830.1 | AGUUUGCAUUUGGAGUUUAGA | 1833 | 3262-3282 | UCUAAACUCCAAAUGCAAACUGG | 1995 | 3260-3282 |
| AD-953838.1 | AGCUUGGUUCCCAUUGGAUCA | 1834 | 3379-3399 | UGAUCCAAUGGGAACCAAGCUGA | 1996 | 3377-3399 |
| AD-953846.1 | CUGAAAUCCUGCUUUAGUCGA | 1835 | 4040-4060 | UCGACUAAAGCAGGAUUUCAGGU | 1997 | 4038-4060 |
| AD-953854.1 | AGAAUGCUAUUCAUAAUCACA | 115 | 4395-4415 | UGUGAUUAUGAAUAGCAUUCUUA | 1998 | 4393-4415 |
| AD-953768.1 | UUAUCAAAGCUUUGAUGGAUA | 1836 | 612-632 | UAUCCAUCAAAGCUUUGAUAACU | 1999 | 610-632 |
| AD-953776.1 | CUCUGCUGAUUCUUGGCGUGA | 1837 | 1074-1094 | UCACGCCAAGAAUCAGCAGAGUG | 2000 | 1072-1094 |
| AD-953784.1 | CACCAAGACCACAAUGUUGUA | 1838 | 1250-1270 | UACAACAUUGUGGUCUUGGUGCU | 2001 | 1248-1270 |
| AD-953792.1 | GAGGAUGACUCUGAAUCGAGA | 1839 | 1505-1525 | UCUCGAUUCAGAGUCAUCCUCCA | 2002 | 1503-1525 |
| AD-953800.1 | CUGAAAUUGUGUUAGACGGUA | 165 | 1887-1907 | UACCGUCUAACACAAUUUCAGAA | 366 | 1885-1907 |
| AD-953808.1 | UCCGCCUUUUAUCUGCUUCGA | 1840 | 2205-2225 | UCGAAGCAGAUAAAAGGCGGACA | 2003 | 2203-2225 |
| AD-953815.1 | GAACUACAUCGAUCAUGGAGA | 1841 | 2413-2433 | UCUCCAUGAUCGAUGUAGUUCAA | 2004 | 2411-2433 |
| AD-953823.1 | GCCUCCAUCUCAUUUCUCCGA | 1842 | 3061-3081 | UCGGAGAAAUGAGAUGGAGGCUG | 2005 | 3059-3081 |

TABLE 8-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953831.1 | GUUUGCAUUUGGAGUUUAGGA | 1843 | 3263-3283 | UCCUAAACUCCAAAUGCAAACUG | 2006 | 3261-3283 |
| AD-953839.1 | AGAUGCUUUGAUUUUGGCCGA | 1844 | 3412-3432 | UCGGCCAAAAUCAAAGCAUCUUG | 2007 | 3410-3432 |
| AD-953847.1 | GAAAUCCUGCUUUAGUCGAGA | 1845 | 4042-4062 | UCUCGACUAAAGCAGGAUUUCAG | 2008 | 4040-4062 |
| AD-953855.1 | GCUAUUCAUAAUCACAUUCGA | 1846 | 4400-4420 | UCGAAUGUGAUUAUGAAUAGCAU | 2009 | 4398-4420 |
| AD-953769.1 | GCUUUGAUGGAUUCUAAUCUA | 1847 | 620-640 | UAGAUUAGAAUCCAUCAAAGCUU | 2010 | 618-640 |
| AD-953777.1 | GCAGCUUGUCCAGGUUUAUGA | 1848 | 1207-1227 | UCAUAAACCUGGACAAGCUGCUC | 2011 | 1205-1227 |
| AD-953785.1 | ACCAAGACCACAAUGUUGUGA | 1849 | 1251-1271 | UCACAACAUUGUGGUCUUGGUGC | 2012 | 1249-1271 |
| AD-953793.1 | AGGAUGACUCUGAAUCGAGAA | 1850 | 1506-1526 | UUCUCGAUUCAGAGUCAUCCUCC | 2013 | 1504-1526 |
| AD-953801.1 | UGAAAUUGUGUUAGACGGUAA | 1851 | 1888-1908 | UUACCGUCUAACACAAUUUCAGA | 2014 | 1886-1908 |
| AD-953809.1 | CCGCCUUUUAUCUGCUUCGUA | 1852 | 2206-2226 | UACGAAGCAGAUAAAAGGCGGAC | 2015 | 2204-2226 |
| AD-953816.1 | CUUUGGCGGAUUGCAUUCCUA | 1853 | 2559-2579 | UAGGAAUGCAAUCCGCCAAAGAA | 2016 | 2557-2579 |
| AD-953824.1 | CCUCCAUCUCAUUUCUCCGUA | 1854 | 3062-3082 | UACGGAGAAAUGAGAUGGAGGCU | 2017 | 3060-3082 |
| AD-953832.1 | GUCUAGGAAGAGCUGUACCGA | 1855 | 3322-3342 | UCGGUACAGCUCUUCCUAGACUC | 2018 | 3320-3342 |
| AD-953840.1 | GGCCGGAAACUUGCUUGCAGA | 1856 | 3427-3447 | UCUGCAAGCAAGUUUCCGGCCAA | 2019 | 3425-3447 |
| AD-953848.1 | UUUAGUCGAGAACCAAUGAUA | 1857 | 4052-4072 | UAUCAUUGGUUCUCGACUAAAGC | 2020 | 4050-4072 |
| AD-953856.1 | UUCAUAAUCACAUUCGUUUGA | 1858 | 4404-4424 | UCAAACGAAUGUGAUUAUGAAUA | 2021 | 4402-4424 |
| AD-953770.1 | GAUUCUAAUCUUCCAAGGUUA | 146 | 629-649 | UAACCUUGGAAGAUUAGAAUCCA | 2022 | 627-649 |
| AD-953778.1 | CAGGUUUAUGAACUGACGUUA | 158 | 1217-1237 | UAACGUCAGUUCAUAAACCUGGA | 359 | 1215-1237 |
| AD-953786.1 | GAGUAUUGUGGAACUUAUAGA | 1859 | 1405-1425 | UCUAUAAGUUCCACAAUACUCCC | 2023 | 1403-1425 |
| AD-953794.1 | GGAUGACUCUGAAUCGAGAUA | 1860 | 1507-1527 | UAUCUCGAUUCAGAGUCAUCCUC | 2024 | 1505-1527 |
| AD-953802.1 | GAAAUUGUGUUAGACGGUACA | 1861 | 1889-1909 | UGUACCGUCUAACACAAUUUCAG | 2025 | 1887-1909 |
| AD-953817.1 | UUUGGCGGAUUGCAUUCCUUA | 1862 | 2560-2580 | UAAGGAAUGCAAUCCGCCAAAGA | 2026 | 2558-2580 |
| AD-953825.1 | CUCCAUCUCAUUUCUCCGUCA | 1863 | 3063-3083 | UGACGGAGAAAUGAGAUGGAGGC | 2027 | 3061-3083 |
| AD-953833.1 | UCUAGGAAGAGCUGUACCGUA | 1864 | 3323-3343 | UACGGUACAGCUCUUCCUAGACU | 2028 | 3321-3343 |
| AD-953841.1 | CUUCUCUAAGUCCCAUCCGAA | 1865 | 3678-3698 | UUCGGAUGGGACUUAGAGAAGGG | 2029 | 3676-3698 |
| AD-953849.1 | UUAGUCGAGAACCAAUGAUGA | 1866 | 4053-4073 | UCAUCAUUGGUUCUCGACUAAAG | 2030 | 4051-4073 |

TABLE 9

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-953857.1 | uscsaua(Ahd)UfcAfCfAfuucguuuguaL96 | 2031 | VPusAfscaaAfcGfAfauguGfaUfuaugasasu | 2205 | AUUCAUAAUCACAUUCGUUUGUU | 984 |
| AD-953865.1 | ususcag(Uhd)UfaCfGfGfguuaauuacaL96 | 2032 | VPusGfsuaaUfuAfAfcccgUfaAfcugaascsc | 2206 | GGUUCAGUUACGGGUUAAUUACU | 1007 |
| AD-953873.1 | ascsugu(Chd)UfcGfAfCfagauagcugaL96 | 2033 | VPusCfsagcUfaUfCfugucGfaGfacaguscsg | 2207 | CGACUGUCUCGACAGAUAGCUGA | 2379 |
| AD-953881.1 | ususacg(Ghd)AfgUfAfUfguucgucacaL96 | 2034 | VPusGfsugaCfgAfAfcauaCfuCfcguaasasa | 2208 | UUUUACGGAGUAUGUUCGUCACU | 2380 |
| AD-953889.1 | gscsaac(Ahd)UfaCfUfUfucuauugccaL96 | 2035 | VPusGfsgcaAfuAfGfaaagUfaUfguugcsusg | 2209 | CAGCAACAUACUUUCUAUUGCCA | 993 |
| AD-953897.1 | ascsucc(Ghd)AfgCfAfCfuuaacguggaL96 | 2036 | VPusCfscacGfuUfAfagugCfuCfggaguscsa | 2210 | UGACUCCGAGCACUUAACGUGGC | 2381 |
| AD-953904.1 | gscsaau(Uhd)CfaGfUfCfucguugugaaL96 | 2037 | VPusUfscacAfaCfGfagacUfgAfauugcscsu | 2211 | AGGCAAUUCAGUCUCGUUGUGAA | 2382 |
| AD-953912.1 | usgsccu(Uhd)CfaUfGfAfugaacucggaL96 | 2038 | VPusCfscgaGfuUfCfaucaUfgAfaggcasusu | 2212 | AAUGCCUUCAUGAUGAACUCGGA | 2383 |
| AD-953920.1 | csasaca(Ghd)CfuAfCfAfcacgugugcaL96 | 2039 | VPusGfscacAfcGfUfguguAfgCfuguugsasc | 2213 | GUCAACAGCUACACACGUGUGCC | 2384 |
| AD-953928.1 | gsascgc(Uhd)GfaCfAfGfaacugcgaaaL96 | 2040 | VPusUfsucgCfaGfUfucugUfcAfgcgucsasc | 2214 | GUGACGCUGACAGAACUGCGAAG | 2385 |
| AD-953936.1 | csusgac(Uhd)UfgUfUfUfacgaaauguaL96 | 2041 | VPusAfscauUfuCfGfuaaaCfaAfgucagscsa | 2215 | UGCUGACUUGUUUACGAAAUGUC | 2386 |
| AD-953858.1 | asuscac(Ahd)UfuCfGfUfuuguuugaaaL96 | 2042 | VPusUfsucaAfaCfAfaacgAfaUfgugaususa | 2216 | UAAUCACAUUCGUUUGUUUGAAC | 2387 |
| AD-953866.1 | csasguu(Ahd)CfgGfGfUfuaauuacugaL96 | 2043 | VPusCfsaguAfaUfUfaaccCfgUfaacugsasa | 2217 | UUCAGUUACGGGUUAAUUACUGU | 2388 |
| AD-953874.1 | asasgcc(Chd)UfuGfGfAfguguuaaauaL96 | 2044 | VPusAfsuuuAfaCfAfcuccAfaGfggcuuscsa | 2218 | UGAAGCCCUUGGAGUGUUAAAUA | 2389 |
| AD-953882.1 | uscsuga(Uhd)UfuCfCfCfagucaacugaL96 | 2045 | VPusCfsaguUfgAfCfugggAfaAfucagasasc | 2219 | GUUCUGAUUUCCCAGUCAACUGA | 2390 |
| AD-953890.1 | asuscuu(Chd)AfaGfUfCfuggaauguuaL96 | 2046 | VPusAfsacaUfuCfCfagacUfuGfaagausgsu | 2220 | ACAUCUUCAAGUCUGGAAUGUUC | 1004 |

TABLE 9-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-953898.1 | asuscca(Ghd)GfcAfAfUfucagucucgaL96 | 2047 | VPusCfsgagAfcUfGfaauuGfcCfuggausgsa | 2221 | UCAUCCAGGCAAUUCAGUCUCGU | 2391 |
| AD-953905.1 | asusggu(Chd)GfaCfAfUfccuugcuugaL96 | 2048 | VPusCfsaagCfaAfGfgaugUfcGfaccausgsc | 2222 | GCAUGGUCGACAUCCUUGCUUGU | 2392 |
| AD-953913.1 | csusuca(Uhd)GfaUfGfAfacucggaguaL96 | 2049 | VPusAfscucCfgAfGfuucaUfcAfugaagsgsc | 2223 | GCCUUCAUGAUGAACUCGGAGUU | 2393 |
| AD-953921.1 | gsascca(Ghd)UfcGfUfAfcucaguuugaL96 | 2050 | VPusCfsaaaCfuGfAfguacGfaCfuggucscsa | 2224 | UGGACCAGUCGUACUCAGUUUGA | 2394 |
| AD-953929.1 | ascsgcu(Ghd)AfcAfGfAfacugcgaagaL96 | 2051 | VPusCfsuucGfcAfGfuucuGfuCfagcguscsa | 2225 | UGACGCUGACAGAACUGCGAAGG | 2395 |
| AD-953937.1 | usgsacu(Uhd)GfuUfUfAfcgaaaugucaL96 | 2052 | VPusGfsacaUfuUfCfguaaAfcAfagucasgsc | 2226 | GCUGACUUGUUUACGAAAUGUCC | 950 |
| AD-953859.1 | usgsuuu(Ghd)AfaCfCfUfcuuguuauaaL96 | 2053 | VPusUfsauaAfcAfAfgaggUfuCfaaacasasa | 2227 | UUUGUUUGAACCUCUUGUUAUAA | 933 |
| AD-953867.1 | uscsaga(Uhd)CfaGfGfUfguuuauuggaL96 | 2054 | VPusCfscaaUfaAfAfcaccUfgAfucugasasu | 2228 | AUUCAGAUCAGGUGUUUAUUGGC | 2396 |
| AD-953875.1 | gscsccu(Uhd)GfgAfGfUfguuaaauacaL96 | 2055 | VPusGfsuauUfuAfAfcacuCfcAfagggcsusu | 2229 | AAGCCCUUGGAGUGUUAAAUACA | 2397 |
| AD-953883.1 | asasgau(Ahd)UfuGfUfUfcuuucucguaL96 | 2056 | VPusAfscgaGfaAfAfgaacAfaUfaucuuscsa | 2230 | UGAAGAUAUUGUUCUUUCUCGUA | 919 |
| AD-953891.1 | uscsaag(Uhd)CfuGfGfAfauguuccggaL96 | 2057 | VPusCfscggAfaCfAfuuccAfgAfcuugasasg | 2231 | CUUCAAGUCUGGAAUGUUCCGGA | 2398 |
| AD-953899.1 | uscscag(Ghd)CfaAfUfUfcagucucguaL96 | 2058 | VPusAfscgaGfaCfUfgaauUfgCfcuggasusg | 2232 | CAUCCAGGCAAUUCAGUCUCGUU | 2399 |
| AD-953906.1 | gsuscga(Chd)AfuCfCfUfugcuugucgaL96 | 2059 | VPusCfsgacAfaGfCfaaggAfuGfucgacscsa | 2233 | UGGUCGACAUCCUUGCUUGUCGC | 2400 |
| AD-953914.1 | csusgcu(Ahd)GfcUfCfCfaugcuuaagaL96 | 2060 | VPusCfsuuaAfgCfAfuggaGfcUfagcagsgsc | 2234 | GCCUGCUAGCUCCAUGCUUAAGC | 2401 |
| AD-953922.1 | ascscag(Uhd)CfgUfAfCfucaguuugaaL96 | 2061 | VPusUfscaaAfcUfGfaguaCfgAfcuggusc sc | 2235 | GGACCAGUCGUACUCAGUUUGAA | 2402 |
| AD-953930.1 | gsasaag(Ghd)AfgAfAfAfgucaguccgaL96 | 2062 | VPusCfsggaCfuGfAfcuuuCfuCfcuuucscsu | 2236 | AGGAAAGGAGAAAGUCAGUCCGG | 2403 |

TABLE 9-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953938.1 | usasacg(Uhd)AfaCfUfCfuuucuaugcaL96 | 2063 | VPusGfscauAfgAfAfagagUfuAfcguuasasa | 2237 | UUUAACGUAACUCUUUCUAUGCC | 982 |
| AD-953860.1 | gsusuug(Ahd)AfcCfUfCfuuguuauaaaL96 | 2064 | VPusUfsuauAfaCfAfagagGfuUfcaaacsasa | 2238 | UUGUUUGAACCUCUUGUUAUAAA | 929 |
| AD-953868.1 | ususggc(Uhd)UfuGfUfAfuugaaacagaL96 | 2065 | VPusCfsuguUfuCfAfauacAfaAfgccaasusa | 2239 | UAUUGGCUUUGUAUUGAAACAGU | 2404 |
| AD-953876.1 | usasgac(Ahd)UfgCfUfUfuuacggaguaL96 | 2066 | VPusAfscucCfgUfAfaaagCfaUfgucuascsc | 2240 | GGUAGACAUGCUUUUACGGAGUA | 2405 |
| AD-953884.1 | gsasuau(Uhd)GfuUfCfUfuucucguauaL96 | 2067 | VPusAfsuacGfaGfAfaagaAfcAfauaucsusu | 2241 | AAGAUAUUGUUCUUUCUCGUAUU | 999 |
| AD-953892.1 | csasagu(Chd)UfgGfAfAfuguuccggaaL96 | 2068 | VPusUfsccgGfaAfCfauucCfaGfacuugsasa | 2242 | UUCAAGUCUGGAAUGUUCCGGAG | 2406 |
| AD-953900.1 | cscsagg(Chd)AfaUfUfCfagucucguuaL96 | 2069 | VPusAfsacgAfgAfCfugaaUfuGfccuggsasu | 2243 | AUCCAGGCAAUUCAGUCUCGUUG | 2407 |
| AD-953907.1 | csasugc(Ahd)AfgAfCfUfcacuuagucaL96 | 2070 | VPusGfsacuAfaGfUfgaguCfuUfgcaugsgsu | 2244 | ACCAUGCAAGACUCACUUAGUCC | 1008 |
| AD-953915.1 | usgscua(Ghd)CfuCfCfAfugcuuaagcaL96 | 2071 | VPusGfscuuAfaGfCfauggAfgCfuagcasgsg | 2245 | CCUGCUAGCUCCAUGCUUAAGCC | 2408 |
| AD-953923.1 | cscsagu(Chd)GfuAfCfUfcaguuugaaaL96 | 2072 | VPusUfsucaAfaCfUfgaguAfcGfacuggsusc | 2246 | GACCAGUCGUACUCAGUUUGAAG | 958 |
| AD-953931.1 | asgsaac(Uhd)UfcAfGfAfcccuaauccaL96 | 2073 | VPusGfsgauUfaGfGfgucuGfaAfguucusasc | 2247 | GUAGAACUUCAGACCCUAAUCCU | 2409 |
| AD-953939.1 | uscsuau(Ghd)CfcCfGfUfguaaaguauaL96 | 2074 | VPusAfsuacUfuUfAfcacgGfgCfauagasasa | 2248 | UUUCUAUGCCCGUGUAAAGUAUG | 2410 |
| AD-953861.1 | ususuga(Ahd)CfcUfCfUfuguuauaaaaL96 | 2075 | VPusUfsuuaUfaAfCfaagaGfgUfucaaascsa | 2249 | UGUUUGAACCUCUUGUUAUAAAA | 928 |
| AD-953869.1 | ususaug(Ahd)AfcGfCfUfaucauucaaaL96 | 2076 | VPusUfsugaAfuGfAfuagcGfuUfcauaasgsa | 2250 | UCUUAUGAACGCUAUCAUUCAAA | 2411 |
| AD-953877.1 | ascsaug(Chd)UfuUfUfAfcggaguaugaL96 | 2077 | VPusCfsauaCfuCfCfguaaAfaGfcaugucsu | 2251 | AGACAUGCUUUUACGGAGUAUGU | 2412 |
| AD-953885.1 | ususguu(Chd)UfuUfCfUfcguauucagaL96 | 2078 | VPusCfsugaAfuAfCfgagaAfaGfaacaasusa | 2252 | UAUUGUUCUUUCUCGUAUUCAGG | 916 |

TABLE 9-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953893.1 | asgscac(Ahd)AfaGfUfUfacuuaguccaL96 | 2079 | VPusGfsgacUfaAfGfuaacUfuUfgugcusgsg | 2253 | CCAGCACAAAGUUACUUAGUCCC | 2413 |
| AD-953901.1 | csasggc(Ahd)AfuUfCfAfgucucguugaL96 | 2080 | VPusCfsaacGfaGfAfcugaAfuUfgccugsgsa | 2254 | UCCAGGCAAUUCAGUCUCGUUGU | 2414 |
| AD-953908.1 | asusgca(Ahd)GfaCfUfCfacuuaguccaL96 | 2081 | VPusGfsgacUfaAfGfugagUfcUfugcausgsg | 2255 | CCAUGCAAGACUCACUUAGUCCC | 2415 |
| AD-953916.1 | ascsugg(Ahd)GfcAfAfGfuugaaugauaL96 | 2082 | VPusAfsucaUfuCfAfacuuGfcUfccagusasg | 2256 | CUACUGGAGCAAGUUGAAUGAUC | 2416 |
| AD-953924.1 | csasguc(Ghd)UfaCfUfCfaguuugaagaL96 | 2083 | VPusCfsuucAfaAfCfugagUfaCfgacugsgsu | 2257 | ACCAGUCGUACUCAGUUUGAAGA | 926 |
| AD-953932.1 | uscsaug(Ahd)AfcAfAfAfgucaucggaaL96 | 2084 | VPusUfsccgAfuGfAfcuuuGfuUfcaugasusg | 2258 | CAUCAUGAACAAAGUCAUCGGAG | 2417 |
| AD-953940.1 | csusaug(Chd)CfcGfUfGfuaaaguaugaL96 | 2085 | VPusCfsauaCfuUfUfacacGfgGfcauagsasa | 2259 | UUCUAUGCCCGUGUAAAGUAUGU | 2418 |
| AD-953862.1 | asasgcu(Uhd)UfaAfAfAfcaguacacgaL96 | 2086 | VPusCfsgugUfaCfUfguuuUfaAfagcuususu | 2260 | AAAAGCUUUAAAACAGUACACGA | 2419 |
| AD-953870.1 | asascgc(Uhd)AfuCfAfUfucaaaacagaL96 | 2087 | VPusCfsuguUfuUfGfaaugAfuAfgcguuscsa | 2261 | UGAACGCUAUCAUUCAAAACAGA | 2420 |
| AD-953878.1 | csusuuu(Ahd)CfgGfAfGfuauguucguaL96 | 2088 | VPusAfscgaAfcAfUfacucCfgUfaaaagscsa | 2262 | UGCUUUUACGGAGUAUGUUCGUC | 2421 |
| AD-953886.1 | usgsuuc(Uhd)UfuCfUfCfguauucaggaL96 | 2089 | VPusCfscugAfaUfAfcgagAfaAfgaacasasu | 2263 | AUUGUUCUUUCUCGUAUUCAGGA | 931 |
| AD-953894.1 | asgsagg(Ahd)GfgAfUfUfcugacuuggaL96 | 2090 | VPusCfscaaGfuCfAfgaauCfcUfccucususc | 2264 | GAAGAGGAGGAUUCUGACUUGGC | 2422 |
| AD-953902.1 | asgsgca(Ahd)UfuCfAfGfucucguuguaL96 | 2091 | VPusAfscaaCfgAfGfacugAfaUfugccusgsg | 2265 | CCAGGCAAUUCAGUCUCGUUGUG | 2423 |
| AD-953909.1 | csascug(Ghd)AfaAfCfAfgugaguccgaL96 | 2092 | VPusCfsggaCfuCfAfcuguUfuCfcagugsasc | 2266 | GUCACUGGAAACAGUGAGUCCGG | 2424 |
| AD-953917.1 | usgsuca(Ahd)CfaGfCfUfacacacgugaL96 | 2093 | VPusCfsacgUfgUfGfuagcUfgUfugacasasg | 2267 | CUUGUCAACAGCUACACACGUGU | 2425 |
| AD-953925.1 | asasgcu(Ghd)AfgCfAfUfuaucagaggaL96 | 2094 | VPusCfscucUfgAfUfaaugCfuCfagcuuscsc | 2268 | GGAAGCUGAGCAUUAUCAGAGGG | 2426 |

TABLE 9-continued

| Modified Sense and Antisense Strand Sequences of Huntingtin (HTT) dsRNA Agents | | | | | | | |
|---|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953933.1 | csgsgcu(Ghd)CfuGfAfCfuuguuuacgaL96 | 2095 | VPusCfsguaAfaCfAfagucAfgCfagccgsgsu | 2269 | ACCGGCUGCUGACUUGUUUACGA | 2427 |
| AD-953941.1 | cscsgcu(Ghd)AfcAfUfUfuccguuguaaL96 | 2096 | VPusUfsacaAfcGfGfaaauGfuCfagcggsgsu | 2270 | ACCCGCUGACAUUUCCGUUGUAC | 2428 |
| AD-953863.1 | asgscug(Ghd)UfuCfAfGfuuacggguuaL96 | 2097 | VPusAfsaccCfgUfAfacugAfaCfcagcusgsc | 2271 | GCAGCUGGUUCAGUUACGGGUUA | 2429 |
| AD-953871.1 | gsusgga(Ahd)GfcGfAfCfugucucgacaL96 | 2098 | VPusGfsucgAfgAfCfagucGfcUfuccacsusu | 2272 | AAGUGGAAGCGACUGUCUCGACA | 2430 |
| AD-953879.1 | ususuua(Chd)GfgAfGfUfauguucgucaL96 | 2099 | VPusGfsacgAfaCfAfuacuCfcGfuaaaasgsc | 2273 | GCUUUUACGGAGUAUGUUCGUCA | 2431 |
| AD-953887.1 | asusuuu(Chd)AfaGfGfUfuucuauuacaL96 | 2100 | VPusGfsuaaUfaGfAfaaccUfuGfaaaausgsu | 2274 | ACAUUUUCAAGGUUUCUAUUACA | 943 |
| AD-953895.1 | csasaua(Ghd)AfgAfAfAfuaguacgaaaL96 | 2101 | VPusUfsucgUfaCfUfauuuCfuCfuauugscsa | 2275 | UGCAAUAGAGAAAUAGUACGAAG | 2432 |
| AD-953903.1 | gsgscaa(Uhd)UfcAfGfUfcucguugugaL96 | 2102 | VPusCfsacaAfcGfAfgacuGfaAfuugccsusg | 2276 | CAGGCAAUUCAGUCUCGUUGUGA | 2433 |
| AD-953910.1 | asgscug(Ghd)UfgAfAfUfcggauuccuaL96 | 2103 | VPusAfsggaAfuCfCfgauuCfaCfcagcuscsu | 2277 | AGAGCUGGUGAAUCGGAUUCCUG | 2434 |
| AD-953918.1 | gsuscaa(Chd)AfgCfUfAfcacacguguaL96 | 2104 | VPusAfscacGfuGfUfguagCfuGfuugacsasa | 2278 | UUGUCAACAGCUACACACGUGUG | 2435 |
| AD-953926.1 | ususgag(Chd)UfgAfUfGfuaugugacgaL96 | 2105 | VPusCfsgucAfcAfUfacauCfaGfcucaasasc | 2279 | GUUUGAGCUGAUGUAUGUGACGC | 2436 |
| AD-953934.1 | gsgscug(Chd)UfgAfCfUfuguuuacgaaL96 | 2106 | VPusUfscguAfaAfCfaaguCfaGfcagccsgsg | 2280 | CCGGCUGCUGACUUGUUUACGAA | 2437 |
| AD-953864.1 | gsusuca(Ghd)UfuAfCfGfgguuaauuaaL96 | 2107 | VPusUfsaauUfaAfCfccguAfaCfugaacscsa | 2281 | UGGUUCAGUUACGGGUUAAUUAC | 957 |
| AD-953872.1 | gsascug(Uhd)CfuCfGfAfcagauagcuaL96 | 2108 | VPusAfsgcuAfuCfUfgucgAfgAfcagucsgsc | 2282 | GCGACUGUCUCGACAGAUAGCUG | 2438 |
| AD-953880.1 | ususuac(Ghd)GfaGfUfAfuguucgucaaL96 | 2109 | VPusUfsgacGfaAfCfauacUfcCfguaaasasg | 2283 | CUUUUACGGAGUAUGUUCGUCAC | 2439 |
| AD-953888.1 | asasggu(Uhd)UfcUfAfUfuacaacuggaL96 | 2110 | VPusCfscagUfuGfUfaauaGfaAfaccuusgsa | 2284 | UCAAGGUUUCUAUUACAACUGGU | 2440 |

TABLE 9-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953896.1 | gsascuc(Chd)GfaGfCfAfcuuaacgugaL96 | 2111 | VPusCfsacgUfuAfAfgugcUfcGfgagucsasu | 2285 | AUGACUCCGAGCACUUAACGUGG | 2441 |
| AD-953911.1 | gscsugg(Uhd)GfaAfUfCfggauuccugaL96 | 2112 | VPusCfsaggAfaUfCfcgauUfcAfccagcsusc | 2286 | GAGCUGGUGAAUCGGAUUCCUGC | 2442 |
| AD-953919.1 | uscsaac(Ahd)GfcUfAfCfacacgugugaL96 | 2113 | VPusCfsacaCfgUfGfuguaGfcUfguugascsa | 2287 | UGUCAACAGCUACACACGUGUGC | 2443 |
| AD-953927.1 | gsasgcu(Ghd)AfuGfUfAfugugacgcuaL96 | 2114 | VPusAfsgcgUfcAfCfauacAfuCfagcucsasa | 2288 | UUGAGCUGAUGUAUGUGACGCUG | 2444 |
| AD-953935.1 | csusgcu(Ghd)AfcUfUfGfuuuacgaaaaL96 | 2115 | VPusUfsuucGfuAfAfacaaGfuCfagcagscsc | 2289 | GGCUGCUGACUUGUUUACGAAAU | 938 |
| AD-953763.1 | asgscua(Chd)CfaAfGfAfaagaccgugaL96 | 2116 | VPusCfsacgGfuCfUfuucuUfgGfuagcusgsa | 2290 | UCAGCUACCAAGAAAGACCGUGU | 2445 |
| AD-953771.1 | asusucu(Ahd)AfuCfUfUfccaagguuaaL96 | 2117 | VPusUfsaacCfuUfGfgaagAfuUfagaauscsc | 2291 | GGAUUCUAAUCUUCCAAGGUUAC | 965 |
| AD-953779.1 | asgsguu(Uhd)AfuGfAfAfcugacguuaaL96 | 2118 | VPusUfsaacGfuCfAfguucAfuAfaaccusgsg | 2292 | CCAGGUUUAUGAACUGACGUUAC | 991 |
| AD-953787.1 | asgsuau(Uhd)GfuGfGfAfacuuauagcaL96 | 2119 | VPusGfscuaUfaAfGfuuccAfcAfauacuscsc | 2293 | GGAGUAUUGUGGAACUUAUAGCU | 2446 |
| AD-953795.1 | gsascuc(Uhd)GfaAfUfCfgagaucggaaL96 | 2120 | VPusUfsccgAfuCfUfcgauUfcAfgagucsasu | 2294 | AUGACUCUGAAUCGAGAUCGGAU | 2447 |
| AD-953803.1 | ascsagc(Ahd)GfuGfUfUfgauaaauuuaL96 | 2121 | VPusAfsaauUfuAfUfcaacAfcUfgcuguscsa | 2295 | UGACAGCAGUGUUGAUAAAUUUG | 1015 |
| AD-953810.1 | csgsccu(Uhd)UfuAfUfCfugcuucguuaL96 | 2122 | VPusAfsacgAfaGfCfagauAfaAfaggcgsgsa | 2296 | UCCGCCUUUUAUCUGCUUCGUUU | 1001 |
| AD-953818.1 | csusgag(Ghd)AfaCfAfGfuuccuauugaL96 | 2123 | VPusCfsaauAfgGfAfacugUfuCfcucagsasg | 2297 | CUCUGAGGAACAGUUCCUAUUGG | 1021 |
| AD-953834.1 | usasgga(Ahd)GfaGfCfUfguaccguugaL96 | 2124 | VPusCfsaacGfgUfAfcagcUfcUfuccuasgsa | 2298 | UCUAGGAAGAGCUGUACCGUUGG | 2448 |
| AD-953842.1 | ususcuc(Uhd)AfaGfUfCfccauccgacaL96 | 2125 | VPusGfsucgGfaUfGfggacUfuAfgagaasgsg | 2299 | CCUUCUCUAAGUCCCAUCCGACG | 2449 |
| AD-953764.1 | csusacc(Ahd)AfgAfAfAfgaccgugugaL96 | 2126 | VPusCfsacaCfgGfUfcuuuCfuUfgguagscsu | 2300 | AGCUACCAAGAAAGACCGUGUGA | 2450 |

TABLE 9-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953772.1 | ususcca(Ahd)GfgUfUfAfcagcucgagaL96 | 2127 | VPusCfsucgAfgCfUfguaaCfcUfuggaasgsa | 2301 | UCUUCCAAGGUUACAGCUCGAGC | 2451 |
| AD-953780.1 | gsgsuuu(Ahd)UfgAfAfCfugacguuacaL96 | 2128 | VPusGfsuaaCfgUfCfaguuCfaUfaaaccsusg | 2302 | CAGGUUUAUGAACUGACGUUACA | 2452 |
| AD-953788.1 | gsusauu(Ghd)UfgGfAfAfcuuauagcuaL96 | 2129 | VPusAfsgcuAfuAfAfguucCfaCfaauacsusc | 2303 | GAGUAUUGUGGAACUUAUAGCUG | 2453 |
| AD-953796.1 | ascsucu(Ghd)AfaUfCfGfagaucggauaL96 | 2130 | VPusAfsuccGfaUfCfucgaUfuCfagaguscsa | 2304 | UGACUCUGAAUCGAGAUCGGAUG | 1011 |
| AD-953804.1 | usgsaua(Ahd)AfuUfUfGfuguugagagaL96 | 2131 | VPusCfsucuCfaAfCfacaaAfuUfuaucasasc | 2305 | GUUGAUAAAUUUGUGUUGAGAGA | 2454 |
| AD-953811.1 | uscsuau(Ahd)AfaGfUfUfccucuugacaL96 | 2132 | VPusGfsucaAfgAfGfgaacUfuUfauagasgsu | 2306 | ACUCUAUAAAGUUCCUCUUGACA | 987 |
| AD-953819.1 | usgsagg(Ahd)AfcAfGfUfuccuauuggaL96 | 2133 | VPusCfscaaUfaGfGfaacuGfuUfccucasgsa | 2307 | UCUGAGGAACAGUUCCUAUUGGC | 2455 |
| AD-953827.1 | uscsucc(Ghd)UfcAfGfCfacaauaaccaL96 | 2134 | VPusGfsguuAfuUfGfugcuGfaCfggagasasa | 2308 | UUUCUCCGUCAGCACAAUAACCA | 2456 |
| AD-953835.1 | asgsgaa(Ghd)AfgCfUfGfuaccguuggaL96 | 2135 | VPusCfscaaCfgGfUfacagCfuCfuuccusasg | 2309 | CUAGGAAGAGCUGUACCGUUGGG | 2457 |
| AD-953843.1 | gsasgaa(Chd)AfaGfCfAfucuguaccgaL96 | 2136 | VPusCfsgguAfcAfGfaugcUfuGfuucucscsu | 2310 | AGGAGAACAAGCAUCUGUACCGU | 2458 |
| AD-953851.1 | gsasgug(Uhd)CfaCfAfAfagaaccgugaL96 | 2137 | VPusCfsacgGfuUfCfuuugUfgAfcacucsgsu | 2311 | ACGAGUGUCACAAAGAACCGUGC | 2459 |
| AD-953765.1 | asasuca(Uhd)UfgUfCfUfgacaauaugaL96 | 2138 | VPusCfsauaUfuGfUfcagaCfaAfugauuscsa | 2312 | UGAAUCAUUGUCUGACAAUAUGU | 2460 |
| AD-953773.1 | uscscaa(Ghd)GfuUfAfCfagcucgagcaL96 | 2139 | VPusGfscucGfaGfCfuguaAfcCfuuggasasg | 2313 | CUUCCAAGGUUACAGCUCGAGCU | 2461 |
| AD-953781.1 | ususuau(Ghd)AfaCfUfGfacguuacauaL96 | 2140 | VPusAfsuguAfaCfGfucagUfuCfauaaascsc | 2314 | GGUUUAUGAACUGACGUUACAUC | 2462 |
| AD-953789.1 | usasuug(Uhd)GfgAfAfCfuuauagcugaL96 | 2141 | VPusCfsagcUfaUfAfaguuCfcAfcaauascsu | 2315 | AGUAUUGUGGAACUUAUAGCUGG | 2463 |
| AD-953797.1 | csuscug(Ahd)AfuCfGfAfgaucggaugaL96 | 2142 | VPusCfsaucCfgAfUfcucgAfuUfcagagsusc | 2316 | GACUCUGAAUCGAGAUCGGAUGU | 2464 |

TABLE 9-continued

| Modified Sense and Antisense Strand Sequences of Huntingtin (HTT) dsRNA Agents | | | | | | | |
|---|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953805.1 | asgsaug(Ahd)AfgCfUfAfcugaaccggaL96 | 2143 | VPusCfscggUfuCfAfguagCfuUfcaucuscsu | 2317 | AGAGAUGAAGCUACUGAACCGGG | 2465 |
| AD-953812.1 | csasucu(Uhd)GfaAfCfUfacaucgaucaL96 | 2144 | VPusGfsaucGfaUfGfuaguUfcAfagaugsusc | 2318 | GACAUCUUGAACUACAUCGAUCA | 2466 |
| AD-953828.1 | uscscgu(Chd)AfgCfAfCfaauaaccagaL96 | 2145 | VPusCfsuggUfuAfUfugugCfuGfacggasgsa | 2319 | UCUCCGUCAGCACAAUAACCAGA | 2467 |
| AD-953836.1 | gsgsaag(Ahd)GfcUfGfUfaccguugggaL96 | 2146 | VPusCfsccaAfcGfGfuacaGfcUfcuuccsusa | 2320 | UAGGAAGAGCUGUACCGUUGGGA | 2468 |
| AD-953852.1 | usgsuca(Chd)AfaAfGfAfaccgugcagaL96 | 2147 | VPusCfsugcAfcGfGfuucuUfuGfugacascsu | 2321 | AGUGUCACAAAGAACCGUGCAGA | 2469 |
| AD-953766.1 | csasuug(Uhd)CfuGfAfCfaauaugugaaL96 | 2148 | VPusUfscacAfuAfUfugucAfgAfcaaugsasu | 2322 | AUCAUUGUCUGACAAUAUGUGAA | 925 |
| AD-953774.1 | csusguu(Chd)CfcAfAfAfauuauggcuaL96 | 2149 | VPusAfsgccAfuAfAfuuuuGfgGfaacagscsu | 2323 | AGCUGUUCCCAAAAUUAUGGCUU | 2470 |
| AD-953782.1 | csasgca(Chd)CfaAfGfAfccacaauguaL96 | 2150 | VPusAfscauUfgUfGfgucuUfgGfugcugsusg | 2324 | CACAGCACCAAGACCACAAUGUU | 2471 |
| AD-953790.1 | asusugu(Ghd)GfaAfCfUfuauagcuggaL96 | 2151 | VPusCfscagCfuAfUfaaguUfcCfacaausasc | 2325 | GUAUUGUGGAACUUAUAGCUGGA | 2472 |
| AD-953798.1 | ususcug(Ahd)AfaUfUfGfuguuagacgaL96 | 2152 | VPusCfsgucUfaAfCfacaaUfuUfcagaascsu | 2326 | AGUUCUGAAAUUGUGUUAGACGG | 2473 |
| AD-953806.1 | cscsucu(Uhd)GfuCfCfAfuuguguccgaL96 | 2153 | VPusCfsggaCfaCfAfauggAfcAfagaggsusg | 2327 | CACCUCUUGUCCAUUGUGUCCGC | 2474 |
| AD-953813.1 | csusuga(Ahd)CfuAfCfAfucgaucaugaL96 | 2154 | VPusCfsaugAfuCfGfauguAfgUfucaagsasu | 2328 | AUCUUGAACUACAUCGAUCAUGG | 930 |
| AD-953821.1 | asasgaa(Chd)GfaGfUfGfcucaauaauaL96 | 2155 | VPusAfsuuaUfuGfAfgcacUfcGfuucuusgsc | 2329 | GCAAGAACGAGUGCUCAAUAAUG | 2475 |
| AD-953829.1 | asasccu(Uhd)UfcAfAfGfaguuauugcaL96 | 2156 | VPusGfscaaUfaAfCfucuuGfaAfagguusasu | 2330 | AUAACCUUUCAAGAGUUAUUGCA | 2476 |
| AD-953837.1 | gsuscag(Chd)UfuGfGfUfucccauuggaL96 | 2157 | VPusCfscaaUfgGfGfaaccAfaGfcugacsgsa | 2331 | UCGUCAGCUUGGUUCCCAUUGGA | 2477 |
| AD-953845.1 | cscsuga(Ahd)AfuCfCfUfgcuuuagucaL96 | 2158 | VPusGfsacuAfaAfGfcaggAfuUfucaggsusa | 2332 | UACCUGAAAUCCUGCUUUAGUCG | 924 |

TABLE 9-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953853.1 | usasaga(Ahd)UfgCfUfAfuucauaaucaL96 | 2159 | VPusGfsauuAfuGfAfauagCfaUfucuuasusc | 2333 | GAUAAGAAUGCUAUUCAUAAUCA | 2478 |
| AD-953767.1 | asasugc(Chd)UfcAfAfCfaaaguuaucaL96 | 2160 | VPusGfsauaAfcUfUfuguuGfaGfgcauuscsg | 2334 | CGAAUGCCUCAACAAAGUUAUCA | 2479 |
| AD-953775.1 | asgsgcc(Uhd)UfcAfUfAfgcgaaccugaL96 | 2161 | VPusCfsaggUfuCfGfcuauGfaAfggccususu | 2335 | AAAGGCCUUCAUAGCGAACCUGA | 2480 |
| AD-953783.1 | gscsacc(Ahd)AfgAfCfCfacaauguugaL96 | 2162 | VPusCfsaacAfuUfGfugguCfuUfggugcsusg | 2336 | CAGCACCAAGACCACAAUGUUGU | 2481 |
| AD-953791.1 | usgsgag(Ghd)AfuGfAfCfucugaaucgaL96 | 2163 | VPusCfsgauUfcAfGfagucAfuCfcuccasasg | 2337 | CUUGGAGGAUGACUCUGAAUCGA | 2482 |
| AD-953799.1 | uscsuga(Ahd)AfuUfGfUfguuagacggaL96 | 2164 | VPusCfscguCfuAfAfcacaAfuUfucagasasc | 2338 | GUUCUGAAAUUGUGUUAGACGGU | 959 |
| AD-953807.1 | csuscuu(Ghd)UfcCfAfUfuguguccgcaL96 | 2165 | VPusGfscggAfcAfCfaaugGfaCfaagagsgsu | 2339 | ACCUCUUGUCCAUUGUGUCCGCC | 2483 |
| AD-953822.1 | gsasgug(Chd)UfcAfAfUfaauguugucaL96 | 2166 | VPusGfsacaAfcAfUfuauuGfaGfcacucsgsu | 2340 | ACGAGUGCUCAAUAAUGUUGUCA | 2484 |
| AD-953830.1 | asgsuuu(Ghd)CfaUfUfUfggaguuuagaL96 | 2167 | VPusCfsuaaAfcUfCfcaaaUfgCfaaacusgsg | 2341 | CCAGUUUGCAUUUGGAGUUUAGG | 2485 |
| AD-953838.1 | asgscuu(Ghd)GfuUfCfCfcauuggaucaL96 | 2168 | VPusGfsaucCfaAfUfgggaAfcCfaagcusgsa | 2342 | UCAGCUUGGUUCCCAUUGGAUCU | 2486 |
| AD-953846.1 | csusgaa(Ahd)UfcCfUfGfcuuuagucgaL96 | 2169 | VPusCfsgacUfaAfAfgcagGfaUfuucagsgsu | 2343 | ACCUGAAAUCCUGCUUUAGUCGA | 2487 |
| AD-953854.1 | asgsaau(Ghd)CfuAfUfUfcauaaucacaL96 | 2170 | VPusGfsugaUfuAfUfgaauAfgCfauucususa | 2344 | UAAGAAUGCUAUUCAUAAUCACA | 921 |
| AD-953768.1 | ususauc(Ahd)AfaGfCfUfuugauggauaL96 | 2171 | VPusAfsuccAfuCfAfaagcUfuUfgauaascsu | 2345 | AGUUAUCAAAGCUUUGAUGGAUU | 2488 |
| AD-953776.1 | csuscug(Chd)UfgAfUfUfcuuggcgugaL96 | 2172 | VPusCfsacgCfcAfAfgaauCfaGfcagagsusg | 2346 | CACUCUGCUGAUUCUUGGCGUGC | 2489 |
| AD-953784.1 | csascca(Ahd)GfaCfCfAfcaauguuguaL96 | 2173 | VPusAfscaaCfaUfUfguggUfcUfuggugscsu | 2347 | AGCACCAAGACCACAAUGUUGUG | 2490 |
| AD-953792.1 | gsasgga(Uhd)GfaCfUfCfugaaucgagaL96 | 2174 | VPusCfsucgAfuUfCfagagUfcAfuccucscsa | 2348 | UGGAGGAUGACUCUGAAUCGAGA | 2491 |

TABLE 9-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953800.1 | csusgaa(Ahd)UfuGfUfGfuuagacgguaL96 | 2175 | VPusAfsccgUfcUfAfacacAfaUfuucagsasa | 2349 | UUCUGAAAUUGUGUUAGACGGUA | 971 |
| AD-953808.1 | uscscgc(Chd)UfuUfUfAfucugcuucgaL96 | 2176 | VPusCfsgaaGfcAfGfauaaAfaGfgcggascsa | 2350 | UGUCCGCCUUUUAUCUGCUUCGU | 2492 |
| AD-953815.1 | gsasacu(Ahd)CfaUfCfGfaucauggagaL96 | 2177 | VPusCfsuccAfuGfAfucgaUfgUfaguucsasa | 2351 | UUGAACUACAUCGAUCAUGGAGA | 2493 |
| AD-953823.1 | gscscuc(Chd)AfuCfUfCfauuucuccgaL96 | 2178 | VPusCfsggaGfaAfAfugagAfuGfgaggcsusg | 2352 | CAGCCUCCAUCUCAUUUCUCCGU | 2494 |
| AD-953831.1 | gsusuug(Chd)AfuUfUfGfgaguuuaggaL96 | 2179 | VPusCfscuaAfaCfUfccaaAfuGfcaaacsusg | 2353 | CAGUUUGCAUUUGGAGUUUAGGU | 2495 |
| AD-953839.1 | asgsaug(Chd)UfuUfGfAfuuuuggccgaL96 | 2180 | VPusCfsggcCfaAfAfaucaAfaGfcaucsusg | 2354 | CAAGAUGCUUUGAUUUUGGCCGG | 2496 |
| AD-953847.1 | gsasaau(Chd)CfuGfCfUfuuagucgagaL96 | 2181 | VPusCfsucgAfcUfAfaagcAfgGfauuucsasg | 2355 | CUGAAAUCCUGCUUUAGUCGAGA | 2497 |
| AD-953855.1 | gscsuau(Uhd)CfaUfAfAfucacauucgaL96 | 2182 | VPusCfsgaaUfgUfGfauuaUfgAfauagcsasu | 2356 | AUGCUAUUCAUAAUCACAUUCGU | 988 |
| AD-953769.1 | gscsuuu(Ghd)AfuGfGfAfuucuaaucuaL96 | 2183 | VPusAfsgauUfaGfAfauccAfuCfaaagcsusu | 2357 | AAGCUUUGAUGGAUUCUAAUCUU | 946 |
| AD-953777.1 | gscsagc(Uhd)UfgUfCfCfagguuuaugaL96 | 2184 | VPusCfsauaAfaCfCfuggaCfaAfgcugcsusc | 2358 | GAGCAGCUUGUCCAGGUUUAUGA | 2498 |
| AD-953785.1 | ascscaa(Ghd)AfcCfAfCfaauguugugaL96 | 2185 | VPusCfsacaAfcAfUfugugGfuCfuuggusgsc | 2359 | GCACCAAGACCACAAUGUUGUGA | 2499 |
| AD-953793.1 | asgsgau(Ghd)AfcUfCfUfgaaucgagaaL96 | 2186 | VPusUfscucGfaUfUfcagaGfuCfauccuscsc | 2360 | GGAGGAUGACUCUGAAUCGAGAU | 2500 |
| AD-953801.1 | usgsaaa(Uhd)UfgUfGfUfuagacgguaaL96 | 2187 | VPusUfsaccGfuCfUfaacaCfaAfuuucasgsa | 2361 | UCUGAAAUUGUGUUAGACGGUAC | 1003 |
| AD-953809.1 | cscsgcc(Uhd)UfuUfAfUfcugcuucguaL96 | 2188 | VPusAfscgaAfgCfAfgauaAfaAfggcggsasc | 2362 | GUCCGCCUUUUAUCUGCUUCGUU | 2501 |
| AD-953816.1 | csusuug(Ghd)CfgGfAfUfugcauuccuaL96 | 2189 | VPusAfsggaAfuGfCfaaucCfgCfcaaagsasa | 2363 | UUCUUUGGCGGAUUGCAUUCCUU | 2502 |
| AD-953824.1 | cscsucc(Ahd)UfcUfCfAfuuucuccguaL96 | 2190 | VPusAfscggAfgAfAfaugaGfaUfggaggscsu | 2364 | AGCCUCCAUCUCAUUUCUCCGUC | 2503 |

TABLE 9-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953832.1 | gsuscua(Ghd)GfaAfGfAfgcuguaccgaL96 | 2191 | VPusCfsgguAfcAfGfcucuUfcCfuagacsusc | 2365 | GAGUCUAGGAAGAGCUGUACCGU | 2504 |
| AD-953840.1 | gsgsccg(Ghd)AfaAfCfUfugcuugcagaL96 | 2192 | VPusCfsugcAfaGfCfaaguUfuCfcggccsasa | 2366 | UUGGCCGGAAACUUGCUUGCAGC | 2505 |
| AD-953848.1 | ususuag(Uhd)CfgAfGfAfaccaaugauaL96 | 2193 | VPusAfsucaUfuGfGfuucuCfgAfcuaaasgsc | 2367 | GCUUUAGUCGAGAACCAAUGAUG | 2506 |
| AD-953856.1 | ususcau(Ahd)AfuCfAfCfauucguuugaL96 | 2194 | VPusCfsaaaCfgAfAfugugAfuUfaugaasusa | 2368 | UAUUCAUAAUCACAUUCGUUUGU | 972 |
| AD-953770.1 | gsasuuc(Uhd)AfaUfCfUfuccaagguuaL96 | 2195 | VPusAfsaccUfuGfGfaagaUfuAfgaaucscsa | 2369 | UGGAUUCUAAUCUUCCAAGGUUA | 952 |
| AD-953778.1 | csasggu(Uhd)UfaUfGfAfacugacguuaL96 | 2196 | VPusAfsacgUfcAfGfuucaUfaAfaccugsgsa | 2370 | UCCAGGUUUAUGAACUGACGUUA | 964 |
| AD-953786.1 | gsasgua(Uhd)UfgUfGfGfaacuuauagaL96 | 2197 | VPusCfsuauAfaGfUfuccaCfaAfuacucscsc | 2371 | GGGAGUAUUGUGGAACUUAUAGC | 998 |
| AD-953794.1 | gsgsaug(Ahd)CfuCfUfGfaaucgagauaL96 | 2198 | VPusAfsucuCfgAfUfucagAfgUfcauccsusc | 2372 | GAGGAUGACUCUGAAUCGAGAUC | 2507 |
| AD-953802.1 | gsasaau(Uhd)GfuGfUfUfagacgguacaL96 | 2199 | VPusGfsuacCfgUfCfuaacAfcAfauuucsasg | 2373 | CUGAAAUUGUGUUAGACGGUACC | 2508 |
| AD-953817.1 | ususugg(Chd)GfgAfUfUfgcauuccuuaL96 | 2200 | VPusAfsaggAfaUfGfcaauCfcGfccaaasgsa | 2374 | UCUUUGGCGGAUUGCAUUCCUUU | 2509 |
| AD-953825.1 | csuscca(Uhd)CfuCfAfUfuucuccgucaL96 | 2201 | VPusGfsacgGfaGfAfaaugAfgAfuggagsgsc | 2375 | GCCUCCAUCUCAUUUCUCCGUCA | 2510 |
| AD-953833.1 | uscsuag(Ghd)AfaGfAfGfcuguaccguaL96 | 2202 | VPusAfscggUfaCfAfgcucUfuCfcuagascsu | 2376 | AGUCUAGGAAGAGCUGUACCGUU | 2511 |
| AD-953841.1 | csusucu(Chd)UfaAfGfUfcccauccgaaL96 | 2203 | VPusUfscggAfuGfGfgacuUfaGfagaagsgsg | 2377 | CCCUUCUCUAAGUCCCAUCCGAC | 2512 |
| AD-953849.1 | ususagu(Chd)GfaGfAfAfccaaugaugaL96 | 2204 | VPusCfsaucAfuUfGfguucUfcGfacuaasasg | 2378 | CUUUAGUCGAGAACCAAUGAUGG | 2513 |

TABLE 11

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953943.1 | AGCUACCAAGAAAGACCGUGA | 1784 | 430-450 | UCACGGTCUUUCUUGGUAGCUGA | 2574 | 428-450 |
| AD-953944.1 | CUACCAAGAAAGACCGUGUGA | 1794 | 432-452 | UCACACGGUCUUUCUUGGUAGCU | 1955 | 430-452 |
| AD-953945.1 | UACCAAGAAAGACCGUGUGAA | 2514 | 433-453 | UUCACACGGUCUUUCUUGGUAGC | 2575 | 431-453 |
| AD-953946.1 | CAUUGUCUGACAAUAUGUGAA | 119 | 455-475 | UUCACATAUUGUCAGACAAUGAU | 320 | 453-475 |
| AD-953947.1 | AAUGCCUCAACAAAGUUAUCA | 1826 | 597-617 | UGAUAACUUUGUUGAGGCAUUCG | 1988 | 595-617 |
| AD-953948.1 | UCAACAAAGUUAUCAAAGCUA | 2515 | 603-623 | UAGCUUTGAUAACUUUGUUGAGG | 2576 | 601-623 |
| AD-953949.1 | CAACAAAGUUAUCAAAGCUUA | 2516 | 604-624 | UAAGCUTUGAUAACUUUGUUGAG | 2577 | 602-624 |
| AD-953950.1 | GCUUUGAUGGAUUCUAAUCUA | 1847 | 620-640 | UAGAUUAGAAUCCAUCAAAGCUU | 2010 | 618-640 |
| AD-953951.1 | UUGAUGGAUUCUAAUCUUCCA | 161 | 623-643 | UGGAAGAUUAGAAUCCAUCAAAG | 362 | 621-643 |
| AD-953952.1 | AUGGAUUCUAAUCUUCCAAGA | 2517 | 626-646 | UCUUGGAAGAUUAGAAUCCAUCA | 2578 | 624-646 |
| AD-953953.1 | GAUUCUAAUCUUCCAAGGUUA | 146 | 629-649 | UAACCUTGGAAGAUUAGAAUCCA | 347 | 627-649 |
| AD-953954.1 | AUUCUAAUCUUCCAAGGUUAA | 1785 | 630-650 | UUAACCTUGGAAGAUUAGAAUCC | 2579 | 628-650 |
| AD-953955.1 | UUCUAAUCUUCCAAGGUUACA | 191 | 631-651 | UGUAACCUUGGAAGAUUAGAAUC | 392 | 629-651 |
| AD-953956.1 | UUCCAAGGUUACAGCUCGAGA | 1795 | 639-659 | UCUCGAGCUGUAACCUUGGAAGA | 1956 | 637-659 |
| AD-953957.1 | UGUUCCCAAAAUUAUGGCUUA | 2518 | 844-864 | UAAGCCAUAAUUUUGGGAACAGC | 2580 | 842-864 |
| AD-953958.1 | AGGCCUUCAUAGCGAACCUGA | 1827 | 909-929 | UCAGGUTCGCUAUGAAGGCCUUU | 2581 | 907-929 |
| AD-953959.1 | CCAGGUUUAUGAACUGACGUA | 2519 | 1216-1236 | UACGUCAGUUCAUAAACCUGGAC | 2582 | 1214-1236 |
| AD-953960.1 | CAGGUUUAUGAACUGACGUUA | 158 | 1217-1237 | UAACGUCAGUUCAUAAACCUGGA | 359 | 1215-1237 |
| AD-953961.1 | AGGUUUAUGAACUGACGUUAA | 1786 | 1218-1238 | UUAACGTCAGUUCAUAAACCUGG | 2583 | 1216-1238 |
| AD-953962.1 | GUUUAUGAACUGACGUUACAA | 2520 | 1220-1240 | UUGUAACGUCAGUUCAUAAACCU | 2584 | 1218-1240 |
| AD-953963.1 | UUUAUGAACUGACGUUACAUA | 1807 | 1221-1241 | UAUGUAACGUCAGUUCAUAAACC | 1968 | 1219-1241 |
| AD-953964.1 | ACUGACGUUACAUCAUACACA | 129 | 1228-1248 | UGUGUATGAUGUAACGUCAGUUC | 330 | 1226-1248 |
| AD-953965.1 | CAGCACCAAGACCACAAUGUA | 1816 | 1247-1267 | UACAUUGUGGUCUUGGUGCUGUG | 1978 | 1245-1267 |
| AD-953966.1 | GCACCAAGACCACAAUGUUGA | 1828 | 1249-1269 | UCAACATUGUGGUCUUGGUGCUG | 2585 | 1247-1269 |
| AD-953967.1 | GCAGCAGCUCUUCAGAACGCA | 2521 | 1291-1311 | UGCGUUCUGAAGAGCUGCUGCAA | 2586 | 1289-1311 |
| AD-953968.1 | GAGUAUUGUGGAACUUAUAGA | 1859 | 1405-1425 | UCUAUAAGUUCCACAAUACUCCC | 2023 | 1403-1425 |
| AD-953969.1 | AGUAUUGUGGAACUUAUAGCA | 1787 | 1406-1426 | UGCUAUAAGUUCCACAAUACUCC | 1948 | 1404-1426 |
| AD-953970.1 | GUAUUGUGGAACUUAUAGCUA | 1797 | 1407-1427 | UAGCUATAAGUUCCACAAUACUC | 2587 | 1405-1427 |
| AD-953971.1 | UGGAGGAUGACUCUGAAUCGA | 1829 | 1503-1523 | UCGAUUCAGAGUCAUCCUCCAAG | 1991 | 1501-1523 |
| AD-953972.1 | GAGGAUGACUCUGAAUCGAGA | 1839 | 1505-1525 | UCUCGATUCAGAGUCAUCCUCCA | 2588 | 1503-1525 |
| AD-953973.1 | AGGAUGACUCUGAAUCGAGAA | 1850 | 1506-1526 | UUCUCGAUUCAGAGUCAUCCUCC | 2013 | 1504-1526 |
| AD-953974.1 | GGAUGACUCUGAAUCGAGAUA | 1860 | 1507-1527 | UAUCUCGAUUCAGAGUCAUCCUC | 2024 | 1505-1527 |
| AD-953975.1 | GACUCUGAAUCGAGAUCGGAA | 1788 | 1511-1531 | UUCCGATCUCGAUUCAGAGUCAU | 2589 | 1509-1531 |
| AD-953976.1 | ACUCUGAAUCGAGAUCGGAUA | 1798 | 1512-1532 | UAUCCGAUCUCGAUUCAGAGUCA | 1959 | 1510-1532 |
| AD-953977.1 | CUCUGAAUCGAGAUCGGAUGA | 1809 | 1513-1533 | UCAUCCGAUCUCGAUUCAGAGUC | 1970 | 1511-1533 |
| AD-953978.1 | UCUGAAUCGAGAUCGGAUGUA | 2522 | 1514-1534 | UACAUCCGAUCUCGAUUCAGAGU | 2590 | 1512-1534 |
| AD-953979.1 | UUCUGAAAUUGUGUUAGACGA | 1818 | 1885-1905 | UCGUCUAACACAAUUUCAGAACU | 1980 | 1883-1905 |

TABLE 11-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-953980.1 | UCUGAAAUUGUGUUAGACGGA | 1830 | 1886-1906 | UCCGUCTAACACAAUUUCAGAAC | 2591 | 1884-1906 |
| AD-953981.1 | CUGAAAUUGUGUUAGACGGUA | 165 | 1887-1907 | UACCGUCUAACACAAUUUCAGAA | 366 | 1885-1907 |
| AD-953982.1 | UGAAAUUGUGUUAGACGGUAA | 1851 | 1888-1908 | UUACCGTCUAACACAAUUUCAGA | 2592 | 1886-1908 |
| AD-953983.1 | GAAAUUGUGUUAGACGGUACA | 1861 | 1889-1909 | UGUACCGUCUAACACAAUUUCAG | 2025 | 1887-1909 |
| AD-953984.1 | CGGUACCGACAACCAGUAUUA | 2523 | 1903-1923 | UAAUACTGGUUGUCGGUACCGUC | 2593 | 1901-1923 |
| AD-953985.1 | ACAGCAGUGUUGAUAAAUUUA | 1789 | 2073-2093 | UAAAUUTAUCAACACUGCUGUCA | 2594 | 2071-2093 |
| AD-953986.1 | CCUCUUGUCCAUUGUGUCCGA | 1819 | 2189-2209 | UCGGACACAAUGGACAAGAGGUG | 1981 | 2187-2209 |
| AD-953987.1 | UCCGCCUUUUAUCUGCUUCGA | 1840 | 2205-2225 | UCGAAGCAGAUAAAAGGCGGACA | 2003 | 2203-2225 |
| AD-953988.1 | CCGCCUUUUAUCUGCUUCGUA | 1852 | 2206-2226 | UACGAAGCAGAUAAAAGGCGGAC | 2015 | 2204-2226 |
| AD-953989.1 | CGCCUUUUAUCUGCUUCGUUA | 1790 | 2207-2227 | UAACGAAGCAGAUAAAAGGCGGA | 1951 | 2205-2227 |
| AD-953990.1 | CAAACUCUAUAAAGUUCCUCA | 2524 | 2347-2367 | UGAGGAACUUUAUAGAGUUUGCU | 2595 | 2345-2367 |
| AD-953991.1 | UCUAUAAAGUUCCUCUUGACA | 181 | 2352-2372 | UGUCAAGAGGAACUUUAUAGAGU | 382 | 2350-2372 |
| AD-953992.1 | CAUCUUGAACUACAUCGAUCA | 1811 | 2407-2427 | UGAUCGAUGUAGUUCAAGAUGUC | 1972 | 2405-2427 |
| AD-953993.1 | AUCUUGAACUACAUCGAUCAA | 2525 | 2408-2428 | UUGAUCGAUGUAGUUCAAGAUGU | 2596 | 2406-2428 |
| AD-953994.1 | UCUUGAACUACAUCGAUCAUA | 2526 | 2409-2429 | UAUGAUCGAUGUAGUUCAAGAUG | 2597 | 2407-2429 |
| AD-953995.1 | CUUGAACUACAUCGAUCAUGA | 1820 | 2410-2430 | UCAUGAUCGAUGUAGUUCAAGAU | 2598 | 2408-2430 |
| AD-953996.1 | UUGAACUACAUCGAUCAUGGA | 211 | 2411-2431 | UCCAUGAUCGAUGUAGUUCAAGA | 412 | 2409-2431 |
| AD-953997.1 | GAACUACAUCGAUCAUGGAGA | 1841 | 2413-2433 | UCUCCAUGAUCGAUGUAGUUCAA | 2599 | 2411-2433 |
| AD-953998.1 | UUUGGCGGAUUGCAUUCCUUA | 1862 | 2560-2580 | UAAGGAAUGCAAUCCGCCAAAGA | 2026 | 2558-2580 |
| AD-953999.1 | UUGGCGGAUUGCAUUCCUUUA | 2527 | 2561-2581 | UAAAGGAAUGCAAUCCGCCAAAG | 2600 | 2559-2581 |
| AD-954000.1 | GCUACAGUGAGUUAGGACUGA | 2528 | 2673-2693 | UCAGUCCUAACUCACUGUAGCUG | 2601 | 2671-2693 |
| AD-954001.1 | CUCUGAGGAACAGUUCCUAUA | 2529 | 2715-2735 | UAUAGGAACUGUUCCUCAGAGUC | 2602 | 2713-2735 |
| AD-954002.1 | CUGAGGAACAGUUCCUAUUGA | 1791 | 2717-2737 | UCAAUAGGAACUGUUCCUCAGAG | 1952 | 2715-2737 |
| AD-954003.1 | UGAGGAACAGUUCCUAUUGGA | 1800 | 2718-2738 | UCCAAUAGGAACUGUUCCUCAGA | 1961 | 2716-2738 |
| AD-954004.1 | GAGGAACAGUUCCUAUUGGCA | 2530 | 2719-2739 | UGCCAATAGGAACUGUUCCUCAG | 2603 | 2717-2739 |
| AD-954005.1 | GAGUGCUCAAUAAUGUUGUCA | 1832 | 2868-2888 | UGACAACAUUAUUGAGCACUCGU | 1994 | 2866-2888 |
| AD-954006.1 | GCCUCCAUCUCAUUUCUCCGA | 1842 | 3061-3081 | UCGGAGAAAUGAGAUGGAGGCUG | 2005 | 3059-3081 |
| AD-954007.1 | CCUCCAUCUCAUUUCUCCGUA | 1854 | 3062-3082 | UACGGAGAAAUGAGAUGGAGGCU | 2017 | 3060-3082 |
| AD-954008.1 | CUCCAUCUCAUUUCUCCGUCA | 1863 | 3063-3083 | UGACGGAGAAAUGAGAUGGAGGC | 2027 | 3061-3083 |
| AD-954009.1 | UCUCCGUCAGCACAAUAACCA | 1801 | 3075-3095 | UGGUUAUGUGCUGACGGAGAAA | 2604 | 3073-3095 |
| AD-954010.1 | CUCCGUCAGCACAAUAACCAA | 2531 | 3076-3096 | UUGGUUAUUGUGCUGACGGAGAA | 2605 | 3074-3096 |
| AD-954011.1 | UCCGUCAGCACAAUAACCAGA | 1812 | 3077-3097 | UCUGGUTAUUGUGCUGACGGAGA | 2606 | 3075-3097 |
| AD-954012.1 | AGAGGCUAUAACCUACUACCA | 2532 | 3104-3124 | UGGUAGTAGGUUAUAGCCUCUAU | 2607 | 3102-3124 |
| AD-954013.1 | ACCUACUACCAAGCAUAACAA | 2533 | 3114-3134 | UUGUUAUGCUUGGUAGUAGGUUA | 2608 | 3112-3134 |
| AD-954014.1 | AACCUUUCAAGAGUUAUUGCA | 1822 | 3152-3172 | UGCAAUAACUCUUGAAAGGUUAU | 1984 | 3150-3172 |
| AD-954015.1 | AGUUUGCAUUUGGAGUUUAGA | 1833 | 3262-3282 | UCUAAACUCCAAAUGCAAACUGG | 1995 | 3260-3282 |
| AD-954016.1 | CAGAUGAGUCUAGGAAGAGCA | 2534 | 3315-3335 | UGCUCUTCCUAGACUCAUCUGAG | 2609 | 3313-3335 |

TABLE 11-continued

| Unmodified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Range in NM_002111.8 | Antisense Sequence 5' to 3' | SEQ ID NO: | Range in NM_002111.8 |
| AD-954017.1 | GUCUAGGAAGAGCUGUACCGA | 1855 | 3322-3342 | UCGGUACAGCUCUUCCUAGACUC | 2018 | 3320-3342 |
| AD-954018.1 | UAGGAAGAGCUGUACCGUUGA | 1792 | 3325-3345 | UCAACGGUACAGCUCUUCCUAGA | 1953 | 3323-3345 |
| AD-954019.1 | GUCAGCUUGGUUCCCAUUGGA | 1823 | 3376-3396 | UCCAAUGGGAACCAAGCUGACGA | 1985 | 3374-3396 |
| AD-954020.1 | GGCCGGAAACUUGCUUGCAGA | 1856 | 3427-3447 | UCUGCAAGCAAGUUUCCGGCCAA | 2019 | 3425-3447 |
| AD-954021.1 | CUUCUCUAAGUCCCAUCCGAA | 1865 | 3678-3698 | UUCGGATGGGACUUAGAGAAGGG | 2610 | 3676-3698 |
| AD-954022.1 | GAGAACAAGCAUCUGUACCGA | 1803 | 3723-3743 | UCGGUACAGAUGCUUGUUCUCCU | 1964 | 3721-3743 |
| AD-954023.1 | AACAAGCAUCUGUACCGUUGA | 2535 | 3726-3746 | UCAACGGUACAGAUGCUUGUUCU | 2611 | 3724-3746 |
| AD-954024.1 | AGCAUCUGUACCGUUGAGUCA | 2536 | 3730-3750 | UGACUCAACGGUACAGAUGCUUG | 2612 | 3728-3750 |
| AD-954025.1 | GCAGCUUCUAGACAAUCUGAA | 2537 | 3773-3793 | UUCAGAUUGUCUAGAAGCUGCAC | 2613 | 3771-3793 |
| AD-954026.1 | UCUAGACAAUCUGAUACCUCA | 148 | 3779-3799 | UGAGGUAUCAGAUUGUCUAGAAG | 349 | 3777-3799 |
| AD-954027.1 | UCAGGUCCUGUUACAACAAGA | 2538 | 3797-3817 | UCUUGUTGUAACAGGACCUGAGG | 2614 | 3795-3817 |
| AD-954028.1 | GGUCCUGUUACAACAAGUAAA | 210 | 3800-3820 | UUUACUTGUUGUAACAGGACCUG | 411 | 3798-3820 |
| AD-954029.1 | CAAGUAAAUCCUCAUCACUGA | 2539 | 3813-3833 | UCAGUGAUGAGGAUUUACUUGUU | 2615 | 3811-3833 |
| AD-954030.1 | UUUCUAUCAUCUUCCUUCAUA | 172 | 3838-3858 | UAUGAAGGAAGAUGAUAGAAACU | 373 | 3836-3858 |
| AD-954031.1 | UUCAUACCUCAAACUGCAUGA | 2540 | 3853-3873 | UCAUGCAGUUUGAGGUAUGAAGG | 2616 | 3851-3873 |
| AD-954032.1 | ACCUCAAACUGCAUGAUGUCA | 2541 | 3858-3878 | UGACAUCAUGCAGUUUGAGGUAU | 2617 | 3856-3878 |
| AD-954033.1 | CAGGACAUUGGGAAGUGUGUA | 2542 | 4001-4021 | UACACACUUCCCAAUGUCCUGCA | 2618 | 3999-4021 |
| AD-954034.1 | CCUGAAAUCCUGCUUUAGUCA | 1824 | 4039-4059 | UGACUAAAGCAGGAUUUCAGGUA | 1986 | 4037-4059 |
| AD-954035.1 | CUGAAAUCCUGCUUUAGUCGA | 1835 | 4040-4060 | UCGACUAAAGCAGGAUUUCAGGU | 1997 | 4038-4060 |
| AD-954036.1 | GAAAUCCUGCUUUAGUCGAGA | 1845 | 4042-4062 | UCUCGACUAAAGCAGGAUUUCAG | 2008 | 4040-4062 |
| AD-954037.1 | AAUCCUGCUUUAGUCGAGAAA | 2543 | 4044-4064 | UUUCUCGACUAAAGCAGGAUUUC | 2619 | 4042-4064 |
| AD-954038.1 | UUUAGUCGAGAACCAAUGAUA | 1857 | 4052-4072 | UAUCAUTGGUUCUCGACUAAAGC | 2620 | 4050-4072 |
| AD-954039.1 | UUAGUCGAGAACCAAUGAUGA | 1866 | 4053-4073 | UCAUCAUUGGUUCUCGACUAAAG | 2621 | 4051-4073 |
| AD-954040.1 | GAUGGCAACUGUUUGUGUUCA | 2544 | 4069-4089 | UGAACACAAACAGUUGCCAUCAU | 2622 | 4067-4089 |
| AD-954041.1 | GAGUGUCACAAAGAACCGUGA | 1804 | 4369-4389 | UCACGGTUCUUUGUGACACUCGU | 2623 | 4367-4389 |
| AD-954042.1 | AGUGUCACAAAGAACCGUGCA | 2545 | 4370-4390 | UGCACGGUUCUUUGUGACACUCG | 2624 | 4368-4390 |
| AD-954043.1 | UGCAGAUAAGAAUGCUAUUCA | 111 | 4387-4407 | UGAAUAGCAUUCUUAUCUGCACG | 312 | 4385-4407 |
| AD-954044.1 | AGAAUGCUAUUCAUAAUCACA | 115 | 4395-4415 | UGUGAUTAUGAAUAGCAUUCUUA | 316 | 4393-4415 |
| AD-954045.1 | GCUAUUCAUAAUCACAUUCGA | 1846 | 4400-4420 | UCGAAUGUGAUUAUGAAUAGCAU | 2009 | 4398-4420 |
| AD-954046.1 | AUCACAUUCGUUUGUUUGAAA | 1717 | 4410-4430 | UUUCAAACAAACGAAUGUGAUUA | 1878 | 4408-4430 |
| AD-954047.1 | UGUUUGAACCUCUUGUUAUAA | 127 | 4422-4442 | UUAUAACAAGAGGUUCAAACAAA | 328 | 4420-4442 |
| AD-954048.1 | GUUUGAACCUCUUGUUAUAAA | 123 | 4423-4443 | UUUAUAACAAGAGGUUCAAACAA | 324 | 4421-4443 |
| AD-954049.1 | UUUGAACCUCUUGUUAUAAAA | 122 | 4424-4444 | UUUUAUAACAAGAGGUUCAAACA | 323 | 4422-4444 |
| AD-954050.1 | GCUUUAAAACAGUACACGACA | 2546 | 4445-4465 | UGUCGUGUACUGUUUUAAAGCUU | 2625 | 4443-4465 |
| AD-954051.1 | AGCUGGUUCAGUUACGGGUUA | 1766 | 4512-4532 | UAACCCGUAACUGAACCAGCUGC | 1927 | 4510-4532 |
| AD-954052.1 | GCUGGUUCAGUUACGGGUUAA | 2547 | 4513-4533 | UUAACCCGUAACUGAACCAGCUG | 2626 | 4511-4533 |
| AD-954053.1 | UGGUUCAGUUACGGGUUAAUA | 2548 | 4515-4535 | UAUUAACCCGUAACUGAACCAGC | 2627 | 4513-4535 |

TABLE 11-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-954054.1 | GUUCAGUUACGGGUUAAUUAA | 1775 | 4517-4537 | UUAAUUAACCCGUAACUGAACCA | 1936 | 4515-4537 |
| AD-954055.1 | CAGUUACGGGUUAAUUACUGA | 1718 | 4520-4540 | UCAGUAAUUAACCCGUAACUGAA | 1879 | 4518-4540 |
| AD-954056.1 | UUACGGGUUAAUUACUGUCUA | 2549 | 4523-4543 | UAGACAGUAAUUAACCCGUAACU | 2628 | 4521-4543 |
| AD-954057.1 | UGGAUUCAGAUCAGGUGUUUA | 131 | 4545-4565 | UAAACACCUGAUCUGAAUCCAGA | 332 | 4543-4565 |
| AD-954058.1 | UAUGAACGCUAUCAUUCAAAA | 196 | 4667-4687 | UUUUGAAUGAUAGCGUUCAUAAG | 397 | 4665-4687 |
| AD-954059.1 | GCGACUGUCUCGACAGAUAGA | 2550 | 4963-4983 | UCUAUCTGUCGAGACAGUCGCUU | 2629 | 4961-4983 |
| AD-954060.1 | CGACUGUCUCGACAGAUAGCA | 2551 | 4964-4984 | UGCUAUCUGUCGAGACAGUCGCU | 2630 | 4962-4984 |
| AD-954061.1 | GACUGUCUCGACAGAUAGCUA | 1776 | 4965-4985 | UAGCUATCUGUCGAGACAGUCGC | 2631 | 4963-4985 |
| AD-954062.1 | ACUGUCUCGACAGAUAGCUGA | 1709 | 4966-4986 | UCAGCUAUCUGUCGAGACAGUCG | 1869 | 4964-4986 |
| AD-954063.1 | CCCAAUGUUAGCCAAACAGCA | 2552 | 4996-5016 | UGCUGUTUGGCUAACAUUGGGAG | 2632 | 4994-5016 |
| AD-954065.1 | CACAUUGACUCUCAUGAAGCA | 2553 | 5021-5041 | UGCUUCAUGAGAGUCAAUGUGCA | 2633 | 5019-5041 |
| AD-954066.1 | GCCCUUGGAGUGUUAAAUACA | 1729 | 5039-5059 | UGUAUUTAACACUCCAAGGGCUU | 2634 | 5037-5059 |
| AD-954067.1 | ACAUGCUUUUACGGAGUAUGA | 1748 | 5100-5120 | UCAUACTCCGUAAAAGCAUGUCU | 2635 | 5098-5120 |
| AD-954068.1 | UUUUACGGAGUAUGUUCGUCA | 1768 | 5106-5126 | UGACGAACAUACUCCGUAAAAGC | 1929 | 5104-5126 |
| AD-954069.1 | UUUACGGAGUAUGUUCGUCAA | 1777 | 5107-5127 | UUGACGAACAUACUCCGUAAAAG | 1938 | 5105-5127 |
| AD-954070.1 | GAGCACUGUUCAACUGUGGAA | 2554 | 5149-5169 | UUCCACAGUUGAACAGUGCUCAC | 2636 | 5147-5169 |
| AD-954071.1 | AAGAUAUUGUUCUUUCUCGUA | 113 | 5217-5237 | UACGAGAAAGAACAAUAUCUUCA | 314 | 5215-5237 |
| AD-954072.1 | GAUAUUGUUCUUUCUCGUAUA | 1739 | 5219-5239 | UAUACGAGAAAGAACAAUAUCUU | 1900 | 5217-5239 |
| AD-954073.1 | UUGUUCUUUCUCGUAUUCAGA | 1749 | 5223-5243 | UCUGAATACGAGAAAGAACAAUA | 2637 | 5221-5243 |
| AD-954074.1 | UGUUCUUUCUCGUAUUCAGGA | 125 | 5224-5244 | UCCUGAAUACGAGAAAGAACAAU | 326 | 5222-5244 |
| AD-954075.1 | AUUUUCAAGGUUUCUAUUACA | 137 | 5368-5388 | UGUAAUAGAAACCUUGAAAAUGU | 338 | 5366-5388 |
| AD-954076.1 | GUGAGCAGCAACAUACUUUCA | 2555 | 5445-5465 | UGAAAGTAUGUUGCUGCUCACUC | 2638 | 5443-5465 |
| AD-954077.1 | GCAACAUACUUUCUAUUGCCA | 187 | 5452-5472 | UGGCAATAGAAAGUAUGUUGCUG | 388 | 5450-5472 |
| AD-954078.1 | AUCUUCAAGUCUGGAAUGUUA | 1721 | 5507-5527 | UAACAUTCCAGACUUGAAGAUGU | 2639 | 5505-5527 |
| AD-954079.1 | CUGCUUGUCAACCACACCGAA | 2556 | 5672-5692 | UUCGGUGUGGUUGACAAGCAGCA | 2640 | 5670-5692 |
| AD-954080.1 | UCCGAGCACUUAACGUGGCUA | 2557 | 5888-5908 | UAGCCACGUUAAGUGCUCGGAGU | 2641 | 5886-5908 |
| AD-954081.1 | CCUCCAGUACAGGACUUCAUA | 2558 | 5951-5971 | UAUGAAGUCCUGUACUGGAGGCU | 2642 | 5949-5971 |
| AD-954082.1 | CAGGCAAUUCAGUCUCGUUGA | 1751 | 6014-6034 | UCAACGAGACUGAAUUGCCUGGA | 1912 | 6012-6034 |
| AD-954083.1 | AGGCAAUUCAGUCUCGUUGUA | 1760 | 6015-6035 | UACAACGAGACUGAAUUGCCUGG | 1921 | 6013-6035 |
| AD-954084.1 | GGCAAUUCAGUCUCGUUGUGA | 1770 | 6016-6036 | UCACAACGAGACUGAAUUGCCUG | 1931 | 6014-6036 |
| AD-954085.1 | GCAAUUCAGUCUCGUUGUGAA | 1712 | 6017-6037 | UUCACAACGAGACUGAAUUGCCU | 1873 | 6015-6037 |
| AD-954086.1 | CAAUUCAGUCUCGUUGUGAAA | 167 | 6018-6038 | UUUCACAACGAGACUGAAUUGCC | 368 | 6016-6038 |
| AD-954087.1 | AUGGUCGACAUCCUUGCUUGA | 1723 | 6170-6190 | UCAAGCAAGGAUGUCGACCAUGC | 1884 | 6168-6190 |
| AD-954088.1 | GGUCGACAUCCUUGCUUGUCA | 2559 | 6172-6192 | UGACAAGCAAGGAUGUCGACCAU | 2643 | 6170-6192 |
| AD-954089.1 | GUCGACAUCCUUGCUUGUCGA | 1732 | 6173-6193 | UCGACAAGCAAGGAUGUCGACCA | 1893 | 6171-6193 |
| AD-954090.1 | CUGGACAGGUUUCGUCUCUCA | 2560 | 6326-6346 | UGAGAGACGAAACCUGUCCAGCA | 2644 | 6324-6346 |
| AD-954091.1 | CAUGCAAGACUCACUUAGUCA | 1742 | 6349-6369 | UGACUAAGUGAGUCUUGCAUGGU | 1903 | 6347-6369 |

TABLE 11-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-954092.1 | AUGCAAGACUCACUUAGUCCA | 1752 | 6350-6370 | UGGACUAAGUGAGUCUUGCAUGG | 1913 | 6348-6370 |
| AD-954093.1 | UGUCACUGGAAACAGUGAGUA | 2561 | 6414-6434 | UACUCACUGUUUCCAGUGACACG | 2645 | 6412-6434 |
| AD-954094.1 | CACUGGAAACAGUGAGUCCGA | 1761 | 6417-6437 | UCGGACTCACUGUUUCCAGUGAC | 2646 | 6415-6437 |
| AD-954095.1 | GCUGGUGAAUCGGAUUCCUGA | 1780 | 6514-6534 | UCAGGAAUCCGAUUCACCAGCUC | 1941 | 6512-6534 |
| AD-954096.1 | AACUCGGAGUUCAACCUAAGA | 2562 | 6560-6580 | UCUUAGGUUGAACUCCGAGUUCA | 2647 | 6558-6580 |
| AD-954097.1 | ACUCGGAGUUCAACCUAAGCA | 2563 | 6561-6581 | UGCUUAGGUUGAACUCCGAGUUC | 2648 | 6559-6581 |
| AD-954098.1 | CUCGGAGUUCAACCUAAGCCA | 2564 | 6562-6582 | UGGCUUAGGUUGAACUCCGAGUU | 2649 | 6560-6582 |
| AD-954099.1 | CUGGAGCAAGUUGAAUGAUCA | 2565 | 6754-6774 | UGAUCAUUCAACUUGCUCCAGUA | 2650 | 6752-6774 |
| AD-954100.1 | AGAGCAGCUUCUUAGUCCAGA | 2566 | 7120-7140 | UCUGGACUAAGAAGCUGCUCUCC | 2651 | 7118-7140 |
| AD-954101.1 | CUUGUCAACAGCUACACACGA | 2567 | 7361-7381 | UCGUGUGUAGCUGUUGACAAGGG | 2652 | 7359-7381 |
| AD-954102.1 | UCAACAGCUACACACGUGUGA | 1781 | 7365-7385 | UCACACGUGUGUAGCUGUUGACA | 1942 | 7363-7385 |
| AD-954103.1 | CAACAGCUACACACGUGUGCA | 1714 | 7366-7386 | UGCACACGUGUGUAGCUGUUGAC | 1875 | 7364-7386 |
| AD-954104.1 | CUUUAAGGAGUUCAUCUACCA | 2568 | 7486-7506 | UGGUAGAUGAACUCCUUAAAGAC | 2653 | 7484-7506 |
| AD-954105.1 | GGACCAGUCGUACUCAGUUUA | 2569 | 7524-7544 | UAAACUGAGUACGACUGGUCCAG | 2654 | 7522-7544 |
| AD-954106.1 | GACCAGUCGUACUCAGUUUGA | 1725 | 7525-7545 | UCAAACTGAGUACGACUGGUCCA | 2655 | 7523-7545 |
| AD-954107.1 | ACCAGUCGUACUCAGUUUGAA | 1734 | 7526-7546 | UUCAAACUGAGUACGACUGGUCC | 1895 | 7524-7546 |
| AD-954108.1 | CCAGUCGUACUCAGUUUGAAA | 1744 | 7527-7547 | UUUCAAACUGAGUACGACUGGUC | 1905 | 7525-7547 |
| AD-954109.1 | CAGUCGUACUCAGUUUGAAGA | 120 | 7528-7548 | UCUUCAAACUGAGUACGACUGGU | 321 | 7526-7548 |
| AD-954110.1 | GACGCUGACAGAACUGCGAAA | 1715 | 8317-8337 | UUUCGCAGUUCUGUCAGCGUCAC | 1876 | 8315-8337 |
| AD-954111.1 | ACGCUGACAGAACUGCGAAGA | 1726 | 8318-8338 | UCUUCGCAGUUCUGUCAGCGUCA | 1887 | 8316-8338 |
| AD-954112.1 | UCAUUGAGAACUAUCCUCUGA | 2570 | 8667-8687 | UCAGAGGAUAGUUCUCAAUGAGG | 2656 | 8665-8687 |
| AD-954113.1 | CGGCUGCUGACUUGUUUACGA | 1764 | 9533-9553 | UCGUAAACAAGUCAGCAGCCGGU | 1925 | 9531-9553 |
| AD-954114.1 | GGCUGCUGACUUGUUUACGAA | 1774 | 9534-9554 | UUCGUAAACAAGUCAGCAGCCGG | 1935 | 9532-9554 |
| AD-954115.1 | CUGCUGACUUGUUUACGAAAA | 1783 | 9536-9556 | UUUUCGTAAACAAGUCAGCAGCC | 2657 | 9534-9556 |
| AD-954116.1 | UGCUGACUUGUUUACGAAAUA | 2571 | 9537-9557 | UAUUUCGUAAACAAGUCAGCAGC | 2658 | 9535-9557 |
| AD-954117.1 | CUGACUUGUUUACGAAAUGUA | 1716 | 9539-9559 | UACAUUTCGUAAACAAGUCAGCA | 2659 | 9537-9559 |
| AD-954118.1 | UGACUUGUUUACGAAAUGUCA | 1727 | 9540-9560 | UGACAUTUCGUAAACAAGUCAGC | 2660 | 9538-9560 |
| AD-954119.1 | UAACGUAACUCUUUCUAUGCA | 1736 | 10173-10193 | UGCAUAGAAAGAGUUACGUUAAA | 1897 | 10171-10193 |
| AD-954120.1 | CCGCUGACAUUUCCGUUGUAA | 1765 | 10311-10331 | UUACAACGGAAAUGUCAGCGGGU | 1926 | 10309-10331 |
| AD-954121.1 | CUGACAUUUCCGUUGUACAUA | 2572 | 10314-10334 | UAUGUACAACGGAAAUGUCAGCG | 2661 | 10312-10334 |
| AD-954122.1 | UCCGUUGUACAUGUUCCUGUA | 2573 | 10322-10342 | UACAGGAACAUGUACAACGGAAA | 2662 | 10320-10342 |

TABLE 12

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-953943.1 | asgscua(Chd)CfaAfGfAfaagaccgugaL96 | 2116 | VPusCfsacgg(Tgn)cuuucuUfgGfuagcusgsa | 2734 | UCAGCUACCAAGAAAGACCGUGU | 2445 |
| AD-953944.1 | csusacc(Ahd)AfgAfAfAfgaccgugugaL96 | 2126 | VPusCfsacac(Ggn)gucuuuCfuUfgguagscsu | 2735 | AGCUACCAAGAAAGACCGUGUGA | 2450 |
| AD-953945.1 | usascca(Ahd)GfaAfAfGfaccgugugaaL96 | 2663 | VPusUfscaca(Cgn)ggucuuUfcUfugguasgsc | 2736 | GCUACCAAGAAAGACCGUGUGAA | 2913 |
| AD-953946.1 | csasuug(Uhd)CfuGfAfCfaauaugugaaL96 | 2148 | VPusUfscaca(Tgn)auugucAfgAfcaaugsasu | 2737 | AUCAUUGUCUGACAAUAUGUGAA | 925 |
| AD-953947.1 | asasugc(Chd)UfcAfAfCfaaaguuaucaL96 | 2160 | VPusGfsauaa(Cgn)uuuguuGfaGfgcauuscsg | 2738 | CGAAUGCCUCAACAAAGUUAUCA | 2479 |
| AD-953948.1 | uscsaac(Ahd)AfaGfUfUfaucaaagcuaL96 | 2664 | VPusAfsgcuu(Tgn)gauaacUfuUfguugasgsg | 2739 | CCUCAACAAAGUUAUCAAAGCUU | 922 |
| AD-953949.1 | csasaca(Ahd)AfgUfUfAfucaaagcuuaL96 | 2665 | VPusAfsagcu(Tgn)ugauaaCfuUfuguugsasg | 2740 | CUCAACAAAGUUAUCAAAGCUUU | 955 |
| AD-953950.1 | gscsuuu(Ghd)AfuGfGfAfuucuaaucuaL96 | 2183 | VPusAfsgauu(Agn)gaauccAfuCfaaagcsusu | 2741 | AAGCUUUGAUGGAUUCUAAUCUU | 946 |
| AD-953951.1 | ususgau(Ghd)GfaUfUfCfuaaucuuccaL96 | 2666 | VPusGfsgaag(Agn)uuagaaUfcCfaucaasasg | 2742 | CUUUGAUGGAUUCUAAUCUUCCA | 967 |
| AD-953952.1 | asusgga(Uhd)UfcUfAfAfucuuccaagaL96 | 2667 | VPusCfsuugg(Agn)agauuaGfaAfuccauscsa | 2743 | UGAUGGAUUCUAAUCUUCCAAGG | 985 |
| AD-953953.1 | gsasuuc(Uhd)AfaUfCfUfuccaagguuaL96 | 2195 | VPusAfsaccu(Tgn)ggaagaUfuAfgaaucscsa | 2744 | UGGAUUCUAAUCUUCCAAGGUUA | 952 |
| AD-953954.1 | asusucu(Ahd)AfuCfUfUfccaagguuaaL96 | 2117 | VPusUfsaacc(Tgn)uggaagAfuUfagaauscsc | 2745 | GGAUUCUAAUCUUCCAAGGUUAC | 965 |
| AD-953955.1 | ususcua(Ahd)UfcUfUfCfcaagguuacaL96 | 2668 | VPusGfsuaac(Cgn)uuggaaGfaUfuagaasusc | 2746 | GAUUCUAAUCUUCCAAGGUUACA | 997 |
| AD-953956.1 | ususcca(Ahd)GfgUfUfAfcagcucgagaL96 | 2127 | VPusCfsucga(Ggn)cuguaaCfcUfuggaasgsa | 2747 | UCUUCCAAGGUUACAGCUCGAGC | 2451 |
| AD-953957.1 | usgsuuc(Chd)CfaAfAfAfuuauggcuuaL96 | 2669 | VPusAfsagcc(Agn)uaauuuUfgGfgaacasgsc | 2748 | GCUGUUCCCAAAAUUAUGGCUUC | 977 |

TABLE 12-continued

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| Modified Sense and Antisense Strand Sequences of Huntingtin (HTT) dsRNA Agents | | | | | | |
| AD-953958.1 | asgsgcc(Uhd)UfcAfUfAfgcgaaccugaL96 | 2161 | VPusCfsaggu(Tgn)cgcuauGfaAfggccususu | 2749 | AAAGGCCUUCAUAGCGAACCUGA | 2480 |
| AD-953959.1 | cscsagg(Uhd)UfuAfUfGfaacugacguaL96 | 2670 | VPusAfscguc(Agn)guucauAfaAfccuggsasc | 2750 | GUCCAGGUUUAUGAACUGACGUU | 974 |
| AD-953960.1 | csasggu(Uhd)UfaUfGfAfacugacguuaL96 | 2196 | VPusAfsacgu(Cgn)aguucaUfaAfaccugsgsa | 2751 | UCCAGGUUUAUGAACUGACGUUA | 964 |
| AD-953961.1 | asgsguu(Uhd)AfuGfAfAfcugacguuaaL96 | 2118 | VPusUfsaacg(Tgn)caguucAfuAfaaccusgsg | 2752 | CCAGGUUUAUGAACUGACGUUAC | 991 |
| AD-953962.1 | gsusuua(Uhd)GfaAfCfUfgacguuacaaL96 | 2671 | VPusUfsguaa(Cgn)gucaguUfcAfuaaacscsu | 2753 | AGGUUUAUGAACUGACGUUACAU | 2914 |
| AD-953963.1 | ususuau(Ghd)AfaCfUfGfacguuacauaL96 | 2140 | VPusAfsugua(Agn)cgucagUfuCfauaaascsc | 2754 | GGUUUAUGAACUGACGUUACAUC | 2462 |
| AD-953964.1 | ascsuga(Chd)GfuUfAfCfaucauacacaL96 | 2672 | VPusGfsugua(Tgn)gauguaAfcGfucagususc | 2755 | GAACUGACGUUACAUCAUACACA | 935 |
| AD-953965.1 | csasgca(Chd)CfaAfGfAfccacaauguaL96 | 2150 | VPusAfscauu(Ggn)uggucuUfgGfugcugsusg | 2756 | CACAGCACCAAGACCACAAUGUU | 2471 |
| AD-953966.1 | gscsacc(Ahd)AfgAfCfCfacaauguugaL96 | 2162 | VPusCfsaaca(Tgn)ugugguCfuUfggugcsusg | 2757 | CAGCACCAAGACCACAAUGUUGU | 2481 |
| AD-953967.1 | gscsagc(Ahd)GfcUfCfUfucagaacgcaL96 | 2673 | VPusGfscguu(Cgn)ugaagaGfcUfgcugcsasa | 2758 | UUGCAGCAGCUCUUCAGAACGCC | 2915 |
| AD-953968.1 | gsasgua(Uhd)UfgUfGfGfaacuuauagaL96 | 2197 | VPusCfsuaua(Agn)guuccaCfaAfuacucscsc | 2759 | GGGAGUAUUGUGGAACUUAUAGC | 998 |
| AD-953969.1 | asgsuau(Uhd)GfuGfGfAfacuuauagcaL96 | 2119 | VPusGfscuau(Agn)aguuccAfcAfauacuscsc | 2760 | GGAGUAUUGUGGAACUUAUAGCU | 2446 |
| AD-953970.1 | gsusauu(Ghd)UfgGfAfAfcuuauagcuaL96 | 2129 | VPusAfsgcua(Tgn)aaguucCfaCfaauacsusc | 2761 | GAGUAUUGUGGAACUUAUAGCUG | 2453 |
| AD-953971.1 | usgsgag(Ghd)AfuGfAfCfucugaaucgaL96 | 2163 | VPusCfsgauu(Cgn)agagucAfuCfcuccasasg | 2762 | CUUGGAGGAUGACUCUGAAUCGA | 2482 |
| AD-953972.1 | gsasgga(Uhd)GfaCfUfCfugaaucgagaL96 | 2174 | VPusCfsucga(Tgn)ucagagUfcAfuccucscsa | 2763 | UGGAGGAUGACUCUGAAUCGAGA | 2491 |
| AD-953973.1 | asgsgau(Ghd)AfcUfCfUfgaaucgagaaL96 | 2186 | VPusUfscucg(Agn)uucagaGfuCfauccuscsc | 2764 | GGAGGAUGACUCUGAAUCGAGAU | 2500 |

TABLE 12-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953974.1 | gsgsaug(Ahd)CfuCfUfGfaaucgagauaL96 | 2198 | VPusAfsucuc(Ggn)auucagAfgUfcauccsusc | 2765 | GAGGAUGACUCUGAAUCGAGAUC | 2507 |
| AD-953975.1 | gsascuc(Uhd)GfaAfUfCfgagaucggaaL96 | 2120 | VPusUfsccga(Tgn)cucgauUfcAfgagucsasu | 2766 | AUGACUCUGAAUCGAGAUCGGAU | 2447 |
| AD-953976.1 | ascsucu(Ghd)AfaUfCfGfagaucggauaL96 | 2130 | VPusAfsuccg(Agn)ucucgaUfuCfagaguscsa | 2767 | UGACUCUGAAUCGAGAUCGGAUG | 1011 |
| AD-953977.1 | csuscug(Ahd)AfuCfGfAfgaucggaugaL96 | 2142 | VPusCfsaucc(Ggn)aucucgAfuUfcagagsusc | 2768 | GACUCUGAAUCGAGAUCGGAUGU | 2464 |
| AD-953978.1 | uscsuga(Ahd)UfcGfAfGfaucggauguaL96 | 2674 | VPusAfscauc(Cgn)gaucucGfaUfucagasgsu | 2769 | ACUCUGAAUCGAGAUCGGAUGUC | 1013 |
| AD-953979.1 | usu");scug(Ahd)AfaUfUfGfuguuagacgaL96 | 2152 | VPusCfsgucu(Agn)acacaaUfuUfcagaascsu | 2770 | AGUUCUGAAAUUGUGUUAGACGG | 2473 |
| AD-953980.1 | uscsuga(Ahd)AfuUfGfUfguuagacggaL96 | 2164 | VPusCfscguc(Tgn)aacacaAfuUfucagasasc | 2771 | GUUCUGAAAUUGUGUUAGACGGU | 959 |
| AD-953981.1 | csusgaa(Ahd)UfuGfUfGfuuagacgguaL96 | 2175 | VPusAfsccgu(Cgn)uaacacAfaUfuucagsasa | 2772 | UUCUGAAAUUGUGUUAGACGGUA | 971 |
| AD-953982.1 | usgsaaa(Uhd)UfgUfGfUfuagacgguaaL96 | 2187 | VPusUfsaccg(Tgn)cuaacaCfaAfuuucasgsa | 2773 | UCUGAAAUUGUGUUAGACGGUAC | 1003 |
| AD-953983.1 | gsasaau(Uhd)GfuGfUfUfagacgguacaL96 | 2199 | VPusGfsuacc(Ggn)ucuaacAfcAfauuucsasg | 2774 | CUGAAAUUGUGUUAGACGGUACC | 2508 |
| AD-953984.1 | csgsgua(Chd)CfgAfCfAfaccaguauuaL96 | 2675 | VPusAfsauac(Tgn)gguuguCfgGfuaccgsusc | 2775 | GACGGUACCGACAACCAGUAUUU | 2916 |
| AD-953985.1 | ascsagc(Ahd)GfuGfUfUfgauaaauuuaL96 | 2121 | VPusAfsaauu(Tgn)aucaacAfcUfgcuguscsa | 2776 | UGACAGCAGUGUUGAUAAAUUUG | 1015 |
| AD-953986.1 | cscsucu(Uhd)GfuCfCfAfuuguguccgaL96 | 2153 | VPusCfsggac(Agn)caauggAfcAfagaggsusg | 2777 | CACCUCUUGUCCAUUGUGUCCGC | 2474 |
| AD-953987.1 | uscscgc(Chd)UfuUfUfAfucugcuucgaL96 | 2176 | VPusCfsgaag(Cgn)agauaaAfaGfgcggascsa | 2778 | UGUCCGCCUUUUAUCUGCUUCGU | 2492 |
| AD-953988.1 | cscsgcc(Uhd)UfuUfAfUfcugcuucguaL96 | 2188 | VPusAfscgaa(Ggn)cagauaAfaAfggcggsasc | 2779 | GUCCGCCUUUUAUCUGCUUCGUU | 2501 |
| AD-953989.1 | csgsccu(Uhd)UfuAfUfCfugcuucguuaL96 | 2122 | VPusAfsacga(Agn)gcagauAfaAfaggcgsgsa | 2780 | UCCGCCUUUUAUCUGCUUCGUUU | 1001 |

TABLE 12-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-953990.1 | csasaac(Uhd)CfuAfUfAfaaguuccucaL96 | 2676 | VPusGfsagga(Agn)cuuuauAfgAfguuugscsu | 2781 | AGCAAACUCUAUAAAGUUCCUCU | 918 |
| AD-953991.1 | uscsuau(Ahd)AfaGfUfUfccucuugacaL96 | 2132 | VPusGfsucaa(Ggn)aggaacUfuUfauagasgsu | 2782 | ACUCUAUAAAGUUCCUCUUGACA | 987 |
| AD-953992.1 | csasucu(Uhd)GfaAfCfUfacaucgaucaL96 | 2144 | VPusGfsaucg(Agn)uguaguUfcAfagaugsusc | 2783 | GACAUCUUGAACUACAUCGAUCA | 2466 |
| AD-953993.1 | asuscuu(Ghd)AfaCfUfAfcaucgaucaaL96 | 2677 | VPusUfsgauc(Ggn)auguagUfuCfaagausgsu | 2784 | ACAUCUUGAACUACAUCGAUCAU | 2917 |
| AD-953994.1 | uscsuug(Ahd)AfcUfAfCfaucgaucauaL96 | 2678 | VPusAfsugau(Cgn)gauguaGfuUfcaagasusg | 2785 | CAUCUUGAACUACAUCGAUCAUG | 2918 |
| AD-953995.1 | csusuga(Ahd)CfuAfCfAfucgaucaugaL96 | 2154 | VPusCfsauga(Tgn)cgauguAfgUfucaagsasu | 2786 | AUCUUGAACUACAUCGAUCAUGG | 930 |
| AD-953996.1 | ususgaa(Chd)UfaCfAfUfcgaucauggaL96 | 2679 | VPusCfscaug(Agn)ucgaugUfaGfuucaasgsa | 2787 | UCUUGAACUACAUCGAUCAUGGA | 1017 |
| AD-953997.1 | gsasacu(Ahd)CfaUfCfGfaucauggagaL96 | 2177 | VPusCfsucca(Tgn)gaucgaUfgUfaguucsasa | 2788 | UUGAACUACAUCGAUCAUGGAGA | 2493 |
| AD-953998.1 | ususugg(Chd)GfgAfUfUfgcauuccuuaL96 | 2200 | VPusAfsagga(Agn)ugcaauCfcGfccaaasgsa | 2789 | UCUUUGGCGGAUUGCAUUCCUUU | 2509 |
| AD-953999.1 | ususggc(Ghd)GfaUfUfGfcauuccuuuaL96 | 2680 | VPusAfsaagg(Agn)augcaaUfcCfgccaasasg | 2790 | CUUUGGCGGAUUGCAUUCCUUUG | 2919 |
| AD-954000.1 | gscsuac(Ahd)GfuGfAfGfuuaggacugaL96 | 2681 | VPusCfsaguc(Cgn)uaacucAfcUfguagcsusg | 2791 | CAGCUACAGUGAGUUAGGACUGC | 2920 |
| AD-954001.1 | csuscug(Ahd)GfgAfAfCfaguuccuauaL96 | 2682 | VPusAfsuagg(Agn)acuguuCfcUfcagagsusc | 2792 | GACUCUGAGGAACAGUUCCUAUU | 1019 |
| AD-954002.1 | csusgag(Ghd)AfaCfAfGfuuccuauugaL96 | 2123 | VPusCfsaaua(Ggn)gaacugUfuCfcucagsasg | 2793 | CUCUGAGGAACAGUUCCUAUUGG | 1021 |
| AD-954003.1 | usgsagg(Ahd)AfcAfGfUfuccuauuggaL96 | 2133 | VPusCfscaau(Agn)ggaacuGfuUfccucasgsa | 2794 | UCUGAGGAACAGUUCCUAUUGGC | 2455 |
| AD-954004.1 | gsasgga(Ahd)CfaGfUfUfccuauuggcaL96 | 2683 | VPusGfsccaa(Tgn)aggaacUfgUfuccucsasg | 2795 | CUGAGGAACAGUUCCUAUUGGCU | 2921 |
| AD-954005.1 | gsasgug(Chd)UfcAfAfUfaauguugucaL96 | 2166 | VPusGfsacaa(Cgn)auuauuGfaGfcacucsgsu | 2796 | ACGAGUGCUCAAUAAUGUUGUCA | 2484 |

TABLE 12-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954006.1 | gscscuc(Chd)AfuCfUfCfauuucuccgaL96 | 2178 | VPusCfsggag(Agn)aaugagAfuGfgaggcsusg | 2797 | CAGCCUCCAUCUCAUUUCUCCGU | 2494 |
| AD-954007.1 | cscsucc(Ahd)UfcUfCfAfuuucuccguaL96 | 2190 | VPusAfscgga(Ggn)aaaugaGfaUfggaggscsu | 2798 | AGCCUCCAUCUCAUUUCUCCGUC | 2503 |
| AD-954008.1 | csuscca(Uhd)CfuCfAfUfuucuccgucaL96 | 2201 | VPusGfsacgg(Agn)gaaaugAfgAfuggagsgsc | 2799 | GCCUCCAUCUCAUUUCUCCGUCA | 2510 |
| AD-954009.1 | uscsucc(Ghd)UfcAfGfCfacaauaaccaL96 | 2134 | VPusGfsguua(Tgn)ugugcuGfaCfggagasasa | 2800 | UUUCUCCGUCAGCACAAUAACCA | 2456 |
| AD-954010.1 | csusccg(Uhd)CfaGfCfAfcaauaaccaaL96 | 2684 | VPusUfsgguu(Agn)uugugcUfgAfcggagsasa | 2801 | UUCUCCGUCAGCACAAUAACCAG | 995 |
| AD-954011.1 | uscscgu(Chd)AfgCfAfCfaauaaccagaL96 | 2145 | VPusCfsuggu(Tgn)auugugCfuGfacggasgsa | 2802 | UCUCCGUCAGCACAAUAACCAGA | 2467 |
| AD-954012.1 | asgsagg(Chd)UfaUfAfAfccuacuaccaL96 | 2685 | VPusGfsguag(Tgn)agguuaUfaGfccucusasu | 2803 | AUAGAGGCUAUAACCUACUACCA | 2922 |
| AD-954013.1 | ascscua(Chd)UfaCfCfAfagcauaacaaL96 | 2686 | VPusUfsguua(Tgn)gcuuggUfaGfuaggususa | 2804 | UAACCUACUACCAAGCAUAACAG | 1012 |
| AD-954014.1 | asasccu(Uhd)UfcAfAfGfaguuauugcaL96 | 2156 | VPusGfscaau(Agn)acucuuGfaAfagguusasu | 2805 | AUAACCUUUCAAGAGUUAUUGCA | 2476 |
| AD-954015.1 | asgsuuu(Ghd)CfaUfUfUfggaguuuagaL96 | 2167 | VPusCfsuaaa(Cgn)uccaaaUfgCfaaacusgsg | 2806 | CCAGUUUGCAUUUGGAGUUUAGG | 2485 |
| AD-954016.1 | csasgau(Ghd)AfgUfCfUfaggaagagcaL96 | 2687 | VPusGfscucu(Tgn)ccuagaCfuCfaucugsasg | 2807 | CUCAGAUGAGUCUAGGAAGAGCU | 2923 |
| AD-954017.1 | gsuscua(Ghd)GfaAfGfAfgcuguaccgaL96 | 2191 | VPusCfsggua(Cgn)agcucuUfcCfuagacsusc | 2808 | GAGUCUAGGAAGAGCUGUACCGU | 2504 |
| AD-954018.1 | usasgga(Ahd)GfaGfCfUfguaccguugaL96 | 2124 | VPusCfsaacg(Ggn)uacagcUfcUfuccuasgsa | 2809 | UCUAGGAAGAGCUGUACCGUUGG | 2448 |
| AD-954019.1 | gsuscag(Chd)UfuGfGfUfucccauuggaL96 | 2157 | VPusCfscaau(Ggn)ggaaccAfaGfcugacsgsa | 2810 | UCGUCAGCUUGGUUCCCAUUGGA | 2477 |
| AD-954020.1 | gsgsccg(Ghd)AfaAfCfUfugcuugcagaL96 | 2192 | VPusCfsugca(Agn)gcaaguUfuCfcggccsasa | 2811 | UUGGCCGGAAACUUGCUUGCAGC | 2505 |

TABLE 12-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954021.1 | csusucu(Chd)UfaAfGfUfcccauccgaaL96 | 2203 | VPusUfscgga(Tgn)gggacuUfaGfagaagsgsg | 2812 | CCCUUCUCUAAGUCCCAUCCGAC | 2512 |
| AD-954022.1 | gsasgaa(Chd)AfaGfCfAfucuguaccgaL96 | 2136 | VPusCfsggua(Cgn)agaugcUfuGfuucucscsu | 2813 | AGGAGAACAAGCAUCUGUACCGU | 2458 |
| AD-954023.1 | asascaa(Ghd)CfaUfCfUfguaccguugaL96 | 2688 | VPusCfsaacg(Ggn)uacagaUfgCfuuguuscsu | 2814 | AGAACAAGCAUCUGUACCGUUGA | 2924 |
| AD-954024.1 | asgscau(Chd)UfgUfAfCfcguugagucaL96 | 2689 | VPusGfsacuc(Agn)acgguaCfaGfaugcusug | 2815 | CAAGCAUCUGUACCGUUGAGUCC | 2925 |
| AD-954025.1 | gscsagc(Uhd)UfcUfAfGfacaaucugaaL96 | 2690 | VPusUfscaga(Tgn)ugucuaGfaAfgcugcsasc | 2816 | GUGCAGCUUCUAGACAAUCUGAU | 932 |
| AD-954026.1 | uscsuag(Ahd)CfaAfUfCfugauaccucaL96 | 2691 | VPusGfsaggu(Agn)ucagauUfgUfcuagasasg | 2817 | CUUCUAGACAAUCUGAUACCUCA | 954 |
| AD-954027.1 | uscsagg(Uhd)CfcUfGfUfuacaacaagaL96 | 2692 | VPusCfsuugu(Tgn)guaacaGfgAfccugasgsg | 2818 | CCUCAGGUCCUGUUACAACAAGU | 2926 |
| AD-954028.1 | gsgsucc(Uhd)GfuUfAfCfaacaaguaaaL96 | 2693 | VPusUfsuacu(Tgn)guuguaAfcAfggaccsusg | 2819 | CAGGUCCUGUUACAACAAGUAAA | 1016 |
| AD-954029.1 | csasagu(Ahd)AfaUfCfCfucaucacugaL96 | 2694 | VPusCfsagug(Agn)ugaggaUfuUfacuugsusu | 2820 | AACAAGUAAAUCCUCAUCACUGG | 966 |
| AD-954030.1 | ususucu(Ahd)UfcAfUfCfuuccuucauaL96 | 2695 | VPusAfsugaa(Ggn)gaagauGfaUfagaaascsu | 2821 | AGUUUCUAUCAUCUUCCUUCAUA | 978 |
| AD-954031.1 | ususcau(Ahd)CfcUfCfAfaacugcaugaL96 | 2696 | VPusCfsaugc(Agn)guuugaGfgUfaugaasgsg | 2822 | CCUUCAUACCUCAAACUGCAUGA | 2927 |
| AD-954032.1 | ascscuc(Ahd)AfaCfUfGfcaugaugucaL96 | 2697 | VPusGfsacau(Cgn)augcagUfuUfgaggusasu | 2823 | AUACCUCAAACUGCAUGAUGUCC | 2928 |
| AD-954033.1 | csasgga(Chd)AfuUfGfGfgaaguguguaL96 | 2698 | VPusAfscaca(Cgn)uucccaAfuGfuccugscsa | 2824 | UGCAGGACAUUGGGAAGUGUGUU | 2929 |
| AD-954034.1 | cscsuga(Ahd)AfuCfCfUfgcuuuagucaL96 | 2158 | VPusGfsacua(Agn)agcaggAfuUfucaggsusa | 2825 | UACCUGAAAUCCUGCUUUAGUCG | 924 |
| AD-954035.1 | csusgaa(Ahd)UfcCfUfGfcuuuagucgaL96 | 2169 | VPusCfsgacu(Agn)aagcagGfaUfuucagsgsu | 2826 | ACCUGAAAUCCUGCUUUAGUCGA | 2487 |
| AD-954036.1 | gsasaau(Chd)CfuGfCfUfuuagucgagaL96 | 2181 | VPusCfsucga(Cgn)uaaagcAfgGfauuucsasg | 2827 | CUGAAAUCCUGCUUUAGUCGAGA | 2497 |

TABLE 12-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954037.1 | asasucc(Uhd)GfcUfUfUfagucgagaaaL96 | 2699 | VPusUfsucuc(Ggn)acuaaaGfcAfggauususc | 2828 | GAAAUCCUGCUUUAGUCGAGAAC | 2930 |
| AD-954038.1 | ususuag(Uhd)CfgAfGfAfaccaaugauaL96 | 2193 | VPusAfsucau(Tgn)gguucuCfgAfcuaaasgsc | 2829 | GCUUUAGUCGAGAACCAAUGAUG | 2506 |
| AD-954039.1 | ususagu(Chd)GfaGfAfAfccaaugaugaL96 | 2204 | VPusCfsauca(Tgn)ugguucUfcGfacuaasasg | 2830 | CUUUAGUCGAGAACCAAUGAUGG | 2513 |
| AD-954040.1 | gsasugg(Chd)AfaCfUfGfuuuguguucaL96 | 2700 | VPusGfsaaca(Cgn)aaacagUfuGfccaucsasu | 2831 | AUGAUGGCAACUGUUUGUGUUCA | 2931 |
| AD-954041.1 | gsasgug(Uhd)CfaCfAfAfagaaccgugaL96 | 2137 | VPusCfsacgg(Tgn)ucuuugUfgAfcacucsgsu | 2832 | ACGAGUGUCACAAAGAACCGUGC | 2459 |
| AD-954042.1 | asgsugu(Chd)AfcAfAfAfgaaccgugcaL96 | 2701 | VPusGfscacg(Ggn)uucuuuGfuGfacacuscsg | 2833 | CGAGUGUCACAAAGAACCGUGCA | 2932 |
| AD-954043.1 | usgscag(Ahd)UfaAfGfAfaugcuauucaL96 | 2702 | VPusGfsaaua(Ggn)cauucuUfaUfcugcascsg | 2834 | CGUGCAGAUAAGAAUGCUAUUCA | 917 |
| AD-954044.1 | asgsaau(Ghd)CfuAfUfUfcauaaucacaL96 | 2170 | VPusGfsugau(Tgn)augaauAfgCfauucususa | 2835 | UAAGAAUGCUAUUCAUAAUCACA | 921 |
| AD-954045.1 | gscsuau(Uhd)CfaUfAfAfucacauucgaL96 | 2182 | VPusCfsgaau(Ggn)ugauuaUfgAfauagcsasu | 2836 | AUGCUAUUCAUAAUCACAUUCGU | 988 |
| AD-954046.1 | asuscac(Ahd)UfuCfGfUfuuguuugaaaL96 | 2042 | VPusUfsucaa(Agn)caaacgAfaUfgugaususa | 2837 | UAAUCACAUUCGUUUGUUUGAAC | 2387 |
| AD-954047.1 | usgsuuu(Ghd)AfaCfCfUfcuuguuauaaL96 | 2053 | VPusUfsauaa(Cgn)aagaggUfuCfaaacasasa | 2838 | UUUGUUUGAACCUCUUGUUAUAA | 933 |
| AD-954048.1 | gsusuug(Ahd)AfcCfUfCfuuguuauaaaL96 | 2064 | VPusUfsuaua(Agn)caagagGfuUfcaaacsasa | 2839 | UUGUUUGAACCUCUUGUUAUAAA | 929 |
| AD-954049.1 | ususuga(Ahd)CfcUfCfUfuguuauaaaaL96 | 2075 | VPusUfsuuau(Agn)acaagaGfgUfucaaascsa | 2840 | UGUUUGAACCUCUUGUUAUAAAA | 928 |
| AD-954050.1 | gscsuuu(Ahd)AfaAfCfAfguacacgacaL96 | 2703 | VPusGfsucgu(Ggn)uacuguUfuUfaaagcsusu | 2841 | AAGCUUUAAAACAGUACACGACU | 990 |
| AD-954051.1 | asgscug(Ghd)UfuCfAfGfuuacggguuaL96 | 2097 | VPusAfsaccc(Ggn)uaacugAfaCfcagcusgsc | 2842 | GCAGCUGGUUCAGUUACGGGUUA | 2429 |

TABLE 12-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-954052.1 | gscsugg(Uhd)UfcAfGfUfuacggguuaaL96 | 2704 | VPusUfsaacc(Cgn)guaacuGfaAfccagcsusg | 2843 | CAGCUGGUUCAGUUACGGGUUAA | 2933 |
| AD-954053.1 | usgsguu(Chd)AfgUfUfAfcggguuaaauaL96 | 2705 | VPusAfsuuaa(Cgn)ccguaaCfuGfaaccasgsc | 2844 | GCUGGUUCAGUUACGGGUUAAUU | 996 |
| AD-954054.1 | gsusuca(Ghd)UfuAfCfGfgguuaauuaaL96 | 2107 | VPusUfsaauu(Agn)acccguAfaCfugaacscsa | 2845 | UGGUUCAGUUACGGGUUAAUUAC | 957 |
| AD-954055.1 | csasguu(Ahd)CfgGfGfUfuaauuacugaL96 | 2043 | VPusCfsagua(Agn)uuaaccCfgUfaacugsasa | 2846 | UUCAGUUACGGGUUAAUUACUGU | 2388 |
| AD-954056.1 | ususacg(Ghd)GfuUfAfAfuuacugucuaL96 | 2706 | VPusAfsgaca(Ggn)uaauuaAfcCfcguaascsu | 2847 | AGUUACGGGUUAAUUACUGUCUU | 2934 |
| AD-954057.1 | usgsgau(Uhd)CfaGfAfUfcagguguuuaL96 | 2707 | VPusAfsaaca(Cgn)cugaucUfgAfauccasgsa | 2848 | UCUGGAUUCAGAUCAGGUGUUUA | 937 |
| AD-954058.1 | usasuga(Ahd)CfgCfUfAfucauucaaaaL96 | 2708 | VPusUfsuuga(Agn)ugauagCfgUfucauasasg | 2849 | CUUAUGAACGCUAUCAUUCAAAA | 1002 |
| AD-954059.1 | gscsgac(Uhd)GfuCfUfCfgacagauagaL96 | 2709 | VPusCfsuauc(Tgn)gucgagAfcAfgucgcsusu | 2850 | AAGCGACUGUCUCGACAGAUAGC | 2935 |
| AD-954060.1 | csgsacu(Ghd)UfcUfCfGfacagauagcaL96 | 2710 | VPusGfscuau(Cgn)ugucgaGfaCfagucgscsu | 2851 | AGCGACUGUCUCGACAGAUAGCU | 2936 |
| AD-954061.1 | gsascug(Uhd)CfuCfGfAfcagauagcuaL96 | 2108 | VPusAfsgcua(Tgn)cugucgAfgAfcagucsgsc | 2852 | GCGACUGUCUCGACAGAUAGCUG | 2438 |
| AD-954062.1 | ascsugu(Chd)UfcGfAfCfagauagcugaL96 | 2033 | VPusCfsagcu(Agn)ucugucGfaGfacaguscsg | 2853 | CGACUGUCUCGACAGAUAGCUGA | 2379 |
| AD-954063.1 | cscscaa(Uhd)GfuUfAfGfccaaacagcaL96 | 2711 | VPusGfscugu(Tgn)uggcuaAfcAfuugggsasg | 2854 | CUCCCAAUGUUAGCCAAACAGCA | 2937 |
| AD-954065.1 | csascau(Uhd)GfaCfUfCfucaugaagcaL96 | 2712 | VPusGfscuuc(Agn)ugagagUfcAfaugugscsa | 2855 | UGCACAUUGACUCUCAUGAAGCC | 2938 |
| AD-954066.1 | gscsccu(Uhd)GfgAfGfUfguuaaauacaL96 | 2055 | VPusGfsuauu(Tgn)aacacuCfcAfagggcsusu | 2856 | AAGCCCUUGGAGUGUUAAAUACA | 2397 |
| AD-954067.1 | ascsaug(Chd)UfuUfUfAfcggaguaugaL96 | 2077 | VPusCfsauac(Tgn)ccguaaAfaGfcauguscsu | 2857 | AGACAUGCUUUUACGGAGUAUGU | 2412 |
| AD-954068.1 | ususuua(Chd)GfgAfGfUfauguucgucaL96 | 2099 | VPusGfsacga(Agn)cauacuCfcGfuaaaasgsc | 2858 | GCUUUUACGGAGUAUGUUCGUCA | 2431 |

TABLE 12-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-954069.1 | ususuac(Ghd)GfaGfUfAfuguucgucaaL96 | 2109 | VPusUfsgacg(Agn)acauacUfcCfguaaasasg | 2859 | CUUUUACGGAGUAUGUUCGUCAC | 2439 |
| AD-954070.1 | gsasgca(Chd)UfgUfUfCfaacuguggaaL96 | 2713 | VPusUfsccac(Agn)guugaaCfaGfugcucsasc | 2860 | GUGAGCACUGUUCAACUGUGGAU | 2939 |
| AD-954071.1 | asasgau(Ahd)UfuGfUfUfcuuucucguaL96 | 2056 | VPusAfscgag(Agn)aagaacAfaUfaucuuscsa | 2861 | UGAAGAUAUUGUUCUUUCUCGUA | 919 |
| AD-954072.1 | gsasuau(Uhd)GfuUfCfUfuucucguauaL96 | 2067 | VPusAfsuacg(Agn)gaaagaAfcAfauaucsusu | 2862 | AAGAUAUUGUUCUUUCUCGUAUU | 999 |
| AD-954073.1 | ususguu(Chd)UfuUfCfUfcguauucagaL96 | 2078 | VPusCfsugaa(Tgn)acgagaAfaGfaacaasusa | 2863 | UAUUGUUCUUUCUCGUAUUCAGG | 916 |
| AD-954074.1 | usgsuuc(Uhd)UfuCfUfCfguauucaggaL96 | 2089 | VPusCfscuga(Agn)uacgagAfaAfgaacasasu | 2864 | AUUGUUCUUUCUCGUAUUCAGGA | 931 |
| AD-954075.1 | asusuuu(Chd)AfaGfGfUfuucuauuacaL96 | 2100 | VPusGfsuaau(Agn)gaaaccUfuGfaaaausgsu | 2865 | ACAUUUUCAAGGUUUCUAUUACA | 943 |
| AD-954076.1 | gsusgag(Chd)AfgCfAfAfcauacuuucaL96 | 2714 | VPusGfsaaag(Tgn)auguugCfuGfcucacsusc | 2866 | GAGUGAGCAGCAACAUACUUUCU | 2940 |
| AD-954077.1 | gscsaac(Ahd)UfaCfUfUfucuauugccaL96 | 2035 | VPusGfsgcaa(Tgn)agaaagUfaUfguugcsusg | 2867 | CAGCAACAUACUUUCUAUUGCCA | 993 |
| AD-954078.1 | asuscuu(Chd)AfaGfUfCfuggaauguuaL96 | 2046 | VPusAfsacau(Tgn)ccagacUfuGfaagausgsu | 2868 | ACAUCUUCAAGUCUGGAAUGUUC | 1004 |
| AD-954079.1 | csusgcu(Uhd)GfuCfAfAfccacaccgaaL96 | 2715 | VPusUfscggu(Ggn)ugguugAfcAfagcagscsa | 2869 | UGCUGCUUGUCAACCACACCGAC | 2941 |
| AD-954080.1 | uscscga(Ghd)CfaCfUfUfaacguggcuaL96 | 2716 | VPusAfsgcca(Cgn)guuaagUfgCfucggasgsu | 2870 | ACUCCGAGCACUUAACGUGGCUC | 2942 |
| AD-954081.1 | cscsucc(Ahd)GfuAfCfAfggacuucauaL96 | 2717 | VPusAfsugaa(Ggn)uccuguAfcUfggaggscsu | 2871 | AGCCUCCAGUACAGGACUUCAUC | 2943 |
| AD-954082.1 | csasggc(Ahd)AfuUfCfAfgucucguugaL96 | 2080 | VPusCfsaacg(Agn)gacugaAfuUfgccugsgsa | 2872 | UCCAGGCAAUUCAGUCUCGUUGU | 2414 |
| AD-954083.1 | asgsgca(Ahd)UfuCfAfGfucucguuguaL96 | 2091 | VPusAfscaac(Ggn)agacugAfaUfugccusgsg | 2873 | CCAGGCAAUUCAGUCUCGUUGUG | 2423 |

TABLE 12-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-954084.1 | gsgscaa(Uhd)UfcAfGfUfcucguugugaL96 | 2102 | VPusCfsacaa(Cgn)gagacuGfaAfuugccsusg | 2874 | CAGGCAAUUCAGUCUCGUUGUGA | 2433 |
| AD-954085.1 | gscsaau(Uhd)CfaGfUfCfucguugugaaL96 | 2037 | VPusUfscaca(Agn)cgagacUfgAfauugcscsu | 2875 | AGGCAAUUCAGUCUCGUUGUGAA | 2382 |
| AD-954086.1 | csasauu(Chd)AfgUfCfUfcguugugaaaL96 | 2718 | VPusUfsucac(Agn)acgagaCfuGfaauugscsc | 2876 | GGCAAUUCAGUCUCGUUGUGAAA | 973 |
| AD-954087.1 | asusggu(Chd)GfaCfAfUfccuugcuugaL96 | 2048 | VPusCfsaagc(Agn)aggaugUfcGfaccausgsc | 2877 | GCAUGGUCGACAUCCUUGCUUGU | 2392 |
| AD-954088.1 | gsgsucg(Ahd)CfaUfCfCfuugcuugucaL96 | 2719 | VPusGfsacaa(Ggn)caaggaUfgUfcgaccsasu | 2878 | AUGGUCGACAUCCUUGCUUGUCG | 2944 |
| AD-954089.1 | gsuscga(Chd)AfuCfCfUfugcuugucgaL96 | 2059 | VPusCfsgaca(Agn)gcaaggAfuGfucgacscsa | 2879 | UGGUCGACAUCCUUGCUUGUCGC | 2400 |
| AD-954090.1 | csusgga(Chd)AfgGfUfUfucgucucucaL96 | 2720 | VPusGfsagag(Agn)cgaaacCfuGfuccagscsa | 2880 | UGCUGGACAGGUUUCGUCUCUCC | 2945 |
| AD-954091.1 | csasugc(Ahd)AfgAfCfUfcacuuagucaL96 | 2070 | VPusGfsacua(Agn)gugaguCfuUfgcaugsgsu | 2881 | ACCAUGCAAGACUCACUUAGUCC | 1008 |
| AD-954092.1 | asusgca(Ahd)GfaCfUfCfacuuagucccaL96 | 2081 | VPusGfsgacu(Agn)agugagUfcUfugcausgsg | 2882 | CCAUGCAAGACUCACUUAGUCCC | 2415 |
| AD-954093.1 | usgsuca(Chd)UfgGfAfAfacagugaguaL96 | 2721 | VPusAfscuca(Cgn)uguuucCfaGfugacascsg | 2883 | CGUGUCACUGGAAACAGUGAGUC | 2946 |
| AD-954094.1 | csascug(Ghd)AfaAfCfAfgugaguccgaL96 | 2092 | VPusCfsggac(Tgn)cacuguUfuCfcagugsasc | 2884 | GUCACUGGAAACAGUGAGUCCGG | 2424 |
| AD-954095.1 | gscsugg(Uhd)GfaAfUfCfggauuccugaL96 | 2112 | VPusCfsagga(Agn)uccgauUfcAfccagcsusc | 2885 | GAGCUGGUGAAUCGGAUUCCUGC | 2442 |
| AD-954096.1 | asascuc(Ghd)GfaGfUfUfcaaccuaagaL96 | 2722 | VPusCfsuuag(Ggn)uugaacUfcCfgaguuscsa | 2886 | UGAACUCGGAGUUCAACCUAAGC | 2947 |
| AD-954097.1 | ascsucg(Ghd)AfgUfUfCfaaccuaagcaL96 | 2723 | VPusGfscuua(Ggn)guugaaCfuCfcgagusֽusc | 2887 | GAACUCGGAGUUCAACCUAAGCC | 1018 |
| AD-954098.1 | csuscgg(Ahd)GfuUfCfAfaccuaagccaL96 | 2724 | VPusGfsgcuu(Agn)gguugaAfcUfccgagsusu | 2888 | AACUCGGAGUUCAACCUAAGCCU | 1020 |
| AD-954099.1 | csusgga(Ghd)CfaAfGfUfugaaugaucaL96 | 2725 | VPusGfsauca(Tgn)ucaacuUfgCfuccagsusa | 2889 | UACUGGAGCAAGUUGAAUGAUCU | 2948 |

TABLE 12-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954100.1 | asgsagc(Ahd)GfcUfUfCfuuaguccagaL96 | 2726 | VPusCfsugga(Cgn)uaagaaGfcUfgcucuscsc | 2890 | GGAGAGCAGCUUCUUAGUCCAGA | 2949 |
| AD-954101.1 | csusugu(Chd)AfaCfAfGfcuacacacgaL96 | 2727 | VPusCfsgugu(Ggn)uagcugUfuGfacaagsgsg | 2891 | CCCUUGUCAACAGCUACACACGU | 2950 |
| AD-954102.1 | uscsaac(Ahd)GfcUfAfCfacacgugugaL96 | 2113 | VPusCfsacac(Ggn)uguguaGfcUfguugascsa | 2892 | UGUCAACAGCUACACACGUGUGC | 2443 |
| AD-954103.1 | csasaca(Ghd)CfuAfCfAfcacgugugcaL96 | 2039 | VPusGfscaca(Cgn)gugugUAfgCfuguugsasc | 2893 | GUCAACAGCUACACACGUGUGCC | 2384 |
| AD-954104.1 | csusuua(Ahd)GfgAfGfUfucaucuaccaL96 | 2728 | VPusGfsguag(Agn)ugaacuCfcUfuaaagsasc | 2894 | GUCUUUAAGGAGUUCAUCUACCG | 979 |
| AD-954105.1 | gsgsacc(Ahd)GfuCfGfUfacucaguuuaL96 | 2729 | VPusAfsaacu(Ggn)aguacgAfcUfgguccsasg | 2895 | CUGGACCAGUCGUACUCAGUUUG | 2951 |
| AD-954106.1 | gsascca(Ghd)UfcGfUfAfcucaguuugaL96 | 2050 | VPusCfsaaac(Tgn)gaguacGfaCfuggucscsa | 2896 | UGGACCAGUCGUACUCAGUUUGA | 2394 |
| AD-954107.1 | ascscag(Uhd)CfgUfAfCfucaguuugaaL96 | 2061 | VPusUfscaaa(Cgn)ugaguaCfgAfcuggucscsc | 2897 | GGACCAGUCGUACUCAGUUUGAA | 2402 |
| AD-954108.1 | cscsagu(Chd)GfuAfCfUfcaguuugaaaL96 | 2072 | VPusUfsucaa(Agn)cugaguAfcGfacuggsusc | 2898 | GACCAGUCGUACUCAGUUUGAAG | 958 |
| AD-954109.1 | csasguc(Ghd)UfaCfUfCfaguuugaagaL96 | 2083 | VPusCfsuuca(Agn)acugagUfaCfgacugsgsu | 2899 | ACCAGUCGUACUCAGUUUGAAGA | 926 |
| AD-954110.1 | gsascgc(Uhd)GfaCfAfGfaacugcgaaaL96 | 2040 | VPusUfsucgc(Agn)guucugUfcAfgcgucsasc | 2900 | GUGACGCUGACAGAACUGCGAAG | 2385 |
| AD-954111.1 | ascsgcu(Ghd)AfcAfGfAfacugcgaagaL96 | 2051 | VPusCfsuucg(Cgn)aguucuGfuCfagcguscsa | 2901 | UGACGCUGACAGAACUGCGAAGG | 2395 |
| AD-954112.1 | uscsauu(Ghd)AfgAfAfCfuauccucugaL96 | 2730 | VPusCfsagag(Ggn)auaguuCfuCfaaugasgsg | 2902 | CCUCAUUGAGAACUAUCCUCUGG | 2952 |
| AD-954113.1 | csgsgcu(Ghd)CfuGfAfCfuuguuuacgaL96 | 2095 | VPusCfsguaa(Agn)caagucAfgCfagccgsgsu | 2903 | ACCGGCUGCUGACUUGUUUACGA | 2427 |
| AD-954114.1 | gsgscug(Chd)UfgAfCfUfuguuuacgaaL96 | 2106 | VPusUfscgua(Agn)acaaguCfaGfcagccsgsg | 2904 | CCGGCUGCUGACUUGUUUACGAA | 2437 |

TABLE 12-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-954115.1 | csusgcu(Ghd)AfcUfUfGfuuuacgaaaaL96 | 2115 | VPusUfsuucg(Tgn)aaacaaGfuCfagcagscsc | 2905 | GGCUGCUGACUUGUUUACGAAAU | 938 |
| AD-954116.1 | usgscug(Ahd)CfuUfGfUfuuacgaaauaL96 | 2731 | VPusAfsuuuc(Ggn)uaaacaAfgUfcagcasgsc | 2906 | GCUGCUGACUUGUUUACGAAAUG | 970 |
| AD-954117.1 | csusgac(Uhd)UfgUfUfUfacgaaauguaL96 | 2041 | VPusAfscauu(Tgn)cguaaaCfaAfgucagscsa | 2907 | UGCUGACUUGUUUACGAAAUGUC | 2386 |
| AD-954118.1 | usgsacu(Uhd)GfuUfUfAfcgaaaugucaL96 | 2052 | VPusGfsacau(Tgn)ucguaaAfcAfagucasgsc | 2908 | GCUGACUUGUUUACGAAAUGUCC | 950 |
| AD-954119.1 | usasacg(Uhd)AfaCfUfCfuuucuaugcaL96 | 2063 | VPusGfscaua(Ggn)aaagagUfuAfcguuasasa | 2909 | UUUAACGUAACUCUUUCUAUGCC | 982 |
| AD-954120.1 | cscsgcu(Ghd)AfcAfUfUfuccguuguaaL96 | 2096 | VPusUfsacaa(Cgn)ggaaauGfuCfagcggsgsu | 2910 | ACCCGCUGACAUUUCCGUUGUAC | 2428 |
| AD-954121.1 | csusgac(Ahd)UfuUfCfCfguuguacauaL96 | 2732 | VPusAfsugua(Cgn)aacggaAfaUfgucagscsg | 2911 | CGCUGACAUUUCCGUUGUACAUG | 962 |
| AD-954122.1 | uscscgu(Uhd)GfuAfCfAfuguuccuguaL96 | 2733 | VPusAfscagg(Agn)acauguAfcAfacggasasa | 2912 | UUUCCGUUGUACAUGUUCCUGUU | 1005 |

TABLE 14

| Unmodified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Range in NM_002111.8 | Antisense Sequence 5' to 3' | SEQ ID NO: | Range in NM_002111.8 |
| AD-954123.1 | AGCUACCAAGAAAGACCGUGA | 1784 | 430-450 | UCACGGTCUUUCUTGGUAGCUGA | 3046 | 428-450 |
| AD-954131.1 | AUUCUAAUCUTCCAAGGUUAA | 2953 | 630-650 | UTAACCTUGGAAGAUTAGAAUCC | 3047 | 628-650 |
| AD-954139.1 | AGGUUUAUGAACUGACGUUAA | 1786 | 1218-1238 | UTAACGTCAGUTCAUAAACCUGG | 3048 | 1216-1238 |
| AD-954147.1 | AGUAUUGUGGAACUUAUAGCA | 1787 | 1406-1426 | UGCUAUAAGUUCCACAAUACUCC | 1948 | 1404-1426 |
| AD-954155.1 | GACUCUGAAUCGAGAUCGGAA | 1788 | 1511-1531 | UTCCGATCUCGAUTCAGAGUCAU | 3049 | 1509-1531 |
| AD-954163.1 | ACAGCAGUGUTGAUAAAUUUA | 2954 | 2073-2093 | UAAATUTAUCAACACTGCUGUCA | 3050 | 2071-2093 |
| AD-954170.1 | CGCCUUUUAUCUGCUUCGUUA | 1790 | 2207-2227 | UAACGAAGCAGAUAAAAGGCGGA | 1951 | 2205-2227 |
| AD-954178.1 | CUGAGGAACAGUUCCUAUUGA | 1791 | 2717-2737 | UCAATAGGAACTGUCCUCAGAG | 3051 | 2715-2737 |
| AD-954186.1 | UUCUCCGUCAGCACAAUAACA | 2955 | 3074-3094 | UGUUAUTGUGCTGACGGAGAAAU | 3052 | 3072-3094 |
| AD-954194.1 | UAGGAAGAGCTGUACCGUUGA | 2956 | 3325-3345 | UCAACGGUACAGCTCTUCCUAGA | 3053 | 3323-3345 |
| AD-954202.1 | UUCUCUAAGUCCCAUCCGACA | 1793 | 3679-3699 | UGUCGGAUGGGACTUAGAGAAGG | 3054 | 3677-3699 |
| AD-954210.1 | UUGUGUUCAACAAUUGUUGAA | 2957 | 4081-4101 | UTCAACAAUUGTUGAACACAAAC | 3055 | 4079-4101 |
| AD-954124.1 | CUACCAAGAAAGACCGUGUGA | 1794 | 432-452 | UCACACGGUCUTUCUTGGUAGCU | 3056 | 430-452 |
| AD-954132.1 | UUCCAAGGTUACAGCUCGAGA | 2958 | 639-659 | UCUCGAGCUGUAACCTUGGAAGA | 3057 | 637-659 |
| AD-954140.1 | GGUUUAUGAACUGACGUUACA | 1796 | 1219-1239 | UGUAACGUCAGTUCATAAACCUG | 3058 | 1217-1239 |
| AD-954148.1 | GUAUUGUGGAACUUAUAGCUA | 1797 | 1407-1427 | UAGCTATAAGUTCCACAAUACUC | 3059 | 1405-1427 |
| AD-954156.1 | ACUCUGAATCGAGAUCGGAUA | 2959 | 1512-1532 | UAUCCGAUCUCGAUTCAGAGUCA | 3060 | 1510-1532 |
| AD-954164.1 | UGAUAAAUTUGUGUUGAGAGA | 2960 | 2083-2103 | UCUCTCAACACAAAUTUAUCAAC | 3061 | 2081-2103 |
| AD-954171.1 | UCUAUAAAGUTCCUCUUGACA | 2961 | 2352-2372 | UGUCAAGAGGAACTUTAUAGAGU | 3062 | 2350-2372 |
| AD-954179.1 | UGAGGAACAGTUCCUAUUGGA | 2962 | 2718-2738 | UCCAAUAGGAACUGUTCCUCAGA | 3063 | 2716-2738 |
| AD-954187.1 | UCUCCGUCAGCACAAUAACCA | 1801 | 3075-3095 | UGGUTATUGUGCUGACGGAGAAA | 3064 | 3073-3095 |
| AD-954195.1 | AGGAAGAGCUGUACCGUUGGA | 1802 | 3326-3346 | UCCAACGGUACAGCUCUUCCUAG | 1963 | 3324-3346 |
| AD-954203.1 | GAGAACAAGCAUCUGUACCGA | 1803 | 3723-3743 | UCGGTACAGAUGCTUGUUCUCCU | 3065 | 3721-3743 |
| AD-954211.1 | GAGUGUCACAAAGAACCGUGA | 1804 | 4369-4389 | UCACGGTUCUUTGTGACACUCGU | 3066 | 4367-4389 |
| AD-954125.1 | AAUCAUUGTCTGACAAUAUGA | 2963 | 452-472 | UCAUAUTGUCAGACAAUGAUUCA | 3067 | 450-472 |
| AD-954133.1 | UCCAAGGUTACAGCUCGAGCA | 2964 | 640-660 | UGCUCGAGCUGTAACCUUGGAAG | 3068 | 638-660 |
| AD-954141.1 | UUUAUGAACUGACGUUACAUA | 1807 | 1221-1241 | UAUGTAACGUCAGTUCAUAAACC | 3069 | 1219-1241 |
| AD-954149.1 | UAUUGUGGAACUUAUAGCUGA | 1808 | 1408-1428 | UCAGCUAUAAGTUCCACAAUACU | 3070 | 1406-1428 |
| AD-954157.1 | CUCUGAAUCGAGAUCGGAUGA | 1809 | 1513-1533 | UCAUCCGAUCUCGAUTCAGAGUC | 3071 | 1511-1533 |
| AD-954165.1 | AGAUGAAGCUACUGAACCGGA | 1810 | 2101-2121 | UCCGGUTCAGUAGCUTCAUCUCU | 3072 | 2099-2121 |
| AD-954172.1 | CAUCUUGAACTACAUCGAUCA | 2965 | 2407-2427 | UGAUCGAUGUAGUTCAAGAUGUC | 3073 | 2405-2427 |
| AD-954180.1 | GAGGAACAGUTCCUAUUGGCA | 2966 | 2719-2739 | UGCCAATAGGAACTGUUCCUCAG | 3074 | 2717-2739 |
| AD-954188.1 | UCCGUCAGCACAAUAACCAGA | 1812 | 3077-3097 | UCUGGUTAUUGUGCUGACGGAGA | 3075 | 3075-3097 |
| AD-954196.1 | GGAAGAGCTGTACCGUUGGGA | 2967 | 3327-3347 | UCCCAACGGUACAGCTCUUCCUA | 3076 | 3325-3347 |
| AD-954204.1 | AACAAGCATCTGUACCGUUGA | 2968 | 3726-3746 | UCAACGGUACAGAUGCUUGUUCU | 3077 | 3724-3746 |
| AD-954212.1 | UGUCACAAAGAACCGUGCAGA | 1814 | 4372-4392 | UCUGCACGGUUCUTUGUGACACU | 3078 | 4370-4392 |
| AD-954126.1 | CAUUGUCUGACAAUAUGUGAA | 119 | 455-475 | UTCACATAUUGTCAGACAAUGAU | 3079 | 453-475 |
| AD-954134.1 | CUGUUCCCAAAAUUAUGGCUA | 1815 | 843-863 | UAGCCATAAUUTUGGGAACAGCU | 3080 | 841-863 |

TABLE 14-continued

| Unmodified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Range in NM_002111.8 | Antisense Sequence 5' to 3' | SEQ ID NO: | Range in NM_002111.8 |
| AD-954142.1 | CAGCACCAAGACCACAAUGUA | 1816 | 1247-1267 | UACAUUGUGGUCUUGGUGCUGUG | 3081 | 1245-1267 |
| AD-954150.1 | AUUGUGGAACTUAUAGCUGGA | 2969 | 1409-1429 | UCCAGCUAUAAGUUCCACAAUAC | 3082 | 1407-1429 |
| AD-954158.1 | UUCUGAAAUGUGUUAGACGA | 2970 | 1885-1905 | UCGUCUAACACAAUUUCAGAACU | 3083 | 1883-1905 |
| AD-954166.1 | CCUCUUGUCCAUUGUGUCCGA | 1819 | 2189-2209 | UCGGACACAAUGGACAAGAGGUG | 1981 | 2187-2209 |
| AD-954173.1 | CUUGAACUACAUCGAUCAUGA | 1820 | 2410-2430 | UCAUGAUCGAUGUAGUUCAAGAU | 3084 | 2408-2430 |
| AD-954181.1 | AAGAACGAGUGCUCAAUAAUA | 1821 | 2862-2882 | UAUUAUUGAGCACUCGUUCUUGC | 3085 | 2860-2882 |
| AD-954189.1 | AACCUUUCAAGAGUUAUUGCA | 1822 | 3152-3172 | UGCAAUAACUCUUGAAAGGUUAU | 3086 | 3150-3172 |
| AD-954197.1 | GUCAGCUUGGTUCCCAUUGGA | 2971 | 3376-3396 | UCCAAUGGGAACCAAGCUGACGA | 1985 | 3374-3396 |
| AD-954205.1 | CCUGAAAUCCTGCUUUAGUCA | 2972 | 4039-4059 | UGACUAAAGCAGGAUUUCAGGUA | 3087 | 4037-4059 |
| AD-954213.1 | UAAGAAUGCUAUUCAUAAUCA | 1825 | 4393-4413 | UGAUUAUGAAUAGCAUUCUUAUC | 3088 | 4391-4413 |
| AD-954127.1 | AAUGCCUCAACAAAGUUAUCA | 1826 | 597-617 | UGAUAACUUUGUUGAGGCAUUCG | 3089 | 595-617 |
| AD-954135.1 | AGGCCUUCAUAGCGAACCUGA | 1827 | 909-929 | UCAGGUUCGCUAUGAAGGCCUUU | 2581 | 907-929 |
| AD-954143.1 | GCACCAAGACCACAAUGUUGA | 1828 | 1249-1269 | UCAACAUUGUGGUCUUGGUGCUG | 3090 | 1247-1269 |
| AD-954151.1 | UGGAGGAUGACUCUGAAUCGA | 1829 | 1503-1523 | UCGAUUCAGAGUCAUCCUCCAAG | 3091 | 1501-1523 |
| AD-954159.1 | UCUGAAAUTGTGUUAGACGGA | 2973 | 1886-1906 | UCCGTCTAACACAAUUUCAGAAC | 3092 | 1884-1906 |
| AD-954167.1 | CUCUUGUCCAUUGUGUCCGCA | 2974 | 2190-2210 | UGCGGACACAAUGGACAAGAGGU | 3093 | 2188-2210 |
| AD-954174.1 | UUGAACUACATCGAUCAUGGA | 2975 | 2411-2431 | UCCAUGAUCGAUGUAGUUCAAGA | 3094 | 2409-2431 |
| AD-954182.1 | GAGUGCUCAATAAUGUUGUCA | 2976 | 2868-2888 | UGACAACAUUAUUGAGCACUCGU | 3095 | 2866-2888 |
| AD-954190.1 | AGUUUGCAUUTGGAGUUUAGA | 2977 | 3262-3282 | UCUAAACUCCAAAUGCAAACUGG | 3096 | 3260-3282 |
| AD-954198.1 | AGCUUGGUTCCCAUUGGAUCA | 2978 | 3379-3399 | UGAUCCAAUGGGAACCAAGCUGA | 1996 | 3377-3399 |
| AD-954206.1 | CUGAAAUCCUGCUUUAGUCGA | 1835 | 4040-4060 | UCGACUAAAGCAGGAUUUCAGGU | 3097 | 4038-4060 |
| AD-954214.1 | AGAAUGCUAUTCAUAAUCACA | 2979 | 4395-4415 | UGUGAUUAUGAAUAGCAUUCUUA | 316 | 4393-4415 |
| AD-954128.1 | UUAUCAAAGCUUGAUGGAUA | 2980 | 612-632 | UAUCCAUCAAAGCUUUGAUAACU | 3098 | 610-632 |
| AD-954136.1 | CUCUGCUGAUTCUUGGCGUGA | 2981 | 1074-1094 | UCACGCCAAGAAUCAGCAGAGUG | 2000 | 1072-1094 |
| AD-954144.1 | CACCAAGACCACAAUGUUGUA | 1838 | 1250-1270 | UACAACAUUGUGGTCTUGGUGCU | 3099 | 1248-1270 |
| AD-954152.1 | GAGGAUGACUCUGAAUCGAGA | 1839 | 1505-1525 | UCUCGAUUCAGAGTCAUCCUCCA | 3100 | 1503-1525 |
| AD-954160.1 | CUGAAAUUGUGUUAGACGGUA | 165 | 1887-1907 | UACCGUCUAACACAAUUUCAGAA | 3101 | 1885-1907 |
| AD-954168.1 | UCCGCCUUUAUCUGCUUCGA | 2982 | 2205-2225 | UCGAAGCAGAUAAAAGGCGGACA | 2003 | 2203-2225 |
| AD-954175.1 | GAACUACATCGAUCAUGGAGA | 2983 | 2413-2433 | UCUCCAUGAUCGAUGUAGUUCAA | 3102 | 2411-2433 |
| AD-954183.1 | GCCUCCAUCUCAUUUCUCCGA | 1842 | 3061-3081 | UCGGAGAAAUGAGAUGGAGGCUG | 2005 | 3059-3081 |
| AD-954191.1 | GUUUGCAUTUGGAGUUUAGGA | 2984 | 3263-3283 | UCCUAAACUCCAAAUGCAAACUG | 2006 | 3261-3283 |
| AD-954199.1 | AGAUGCUUTGAUUUUGGCCGA | 2985 | 3412-3432 | UCGGCCAAAAUCAAAGCAUCUUG | 2007 | 3410-3432 |
| AD-954207.1 | GAAAUCCUGCTUUAGUCGAGA | 2986 | 4042-4062 | UCUCGACUAAAGCAGGAUUUCAG | 2008 | 4040-4062 |
| AD-954215.1 | GCUAUUCATAAUCACAUUCGA | 2987 | 4400-4420 | UCGAAUGUGAUTATGAAUAGCAU | 3103 | 4398-4420 |
| AD-954129.1 | GCUUUGAUGGAUUCUAAUCUA | 1847 | 620-640 | UAGAUUAGAAUCCAUCAAAGCUU | 3104 | 618-640 |
| AD-954137.1 | GCAGCUUGTCCAGGUUUAUGA | 2988 | 1207-1227 | UCAUAAACCUGGACAAGCUGCUC | 2011 | 1205-1227 |
| AD-954145.1 | ACCAAGACCACAAUGUUGUGA | 1849 | 1251-1271 | UCACAACAUUGUGGUCUUGGUGC | 3105 | 1249-1271 |

TABLE 14-continued

| Unmodified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Range in NM_002111.8 | Antisense Sequence 5' to 3' | SEQ ID NO: | Range in NM_002111.8 |
| AD-954153.1 | AGGAUGACTCTGAAUCGAGAA | 2989 | 1506-1526 | UTCUCGAUUCAGAGUCAUCCUCC | 3106 | 1504-1526 |
| AD-954161.1 | UGAAAUUGTGTUAGACGGUAA | 2990 | 1888-1908 | UTACCGTCUAACACAAUUUCAGA | 3107 | 1886-1908 |
| AD-954169.1 | CCGCCUUUTATCUGCUUCGUA | 2991 | 2206-2226 | UACGAAGCAGATAAAAGGCGGAC | 3108 | 2204-2226 |
| AD-954176.1 | CUUUGGCGGATUGCAUUCCUA | 2992 | 2559-2579 | UAGGAATGCAATCCGCCAAAGAA | 3109 | 2557-2579 |
| AD-954184.1 | CCUCCAUCTCAUUUCUCCGUA | 2993 | 3062-3082 | UACGGAGAAAUGAGATGGAGGCU | 3110 | 3060-3082 |
| AD-954192.1 | GUCUAGGAAGAGCUGUACCGA | 1855 | 3322-3342 | UCGGTACAGCUCUTCCUAGACUC | 3111 | 3320-3342 |
| AD-954200.1 | GGCCGGAAACTUGCUUGCAGA | 2994 | 3427-3447 | UCUGCAAGCAAGUTCCGGCCAA | 3112 | 3425-3447 |
| AD-954208.1 | UUUAGUCGAGAACCAAUGAUA | 1857 | 4052-4072 | UAUCAUTGGUUCUCGACUAAAGC | 2620 | 4050-4072 |
| AD-954216.1 | UUCAUAAUCACAUUCGUUUGA | 1858 | 4404-4424 | UCAAACGAAUGTGAUTAUGAAUA | 3113 | 4402-4424 |
| AD-954130.1 | GAUUCUAATCTUCCAAGGUUA | 2995 | 629-649 | UAACCUTGGAAGATUAGAAUCCA | 3114 | 627-649 |
| AD-954138.1 | CAGGUUUATGAACUGACGUUA | 2996 | 1217-1237 | UAACGUCAGUUCATAAACCUGGA | 3115 | 1215-1237 |
| AD-954146.1 | GAGUAUUGTGGAACUUAUAGA | 2997 | 1405-1425 | UCUATAAGUUCCACAAUACUCCC | 3116 | 1403-1425 |
| AD-954154.1 | GGAUGACUCUGAAUCGAGAUA | 1860 | 1507-1527 | UAUCTCGAUUCAGAGTCAUCCUC | 3117 | 1505-1527 |
| AD-954162.1 | GAAAUUGUGUTAGACGGUACA | 2998 | 1889-1909 | UGUACCGUCUAACACAAUUUCAG | 2025 | 1887-1909 |
| AD-954177.1 | UUUGGCGGAUTGCAUUCCUUA | 2999 | 2560-2580 | UAAGGAAUGCAAUCCGCCAAAGA | 2026 | 2558-2580 |
| AD-954185.1 | CUCCAUCUCATUUCUCCGUCA | 3000 | 3063-3083 | UGACGGAGAAATGAGAUGGAGGC | 3118 | 3061-3083 |
| AD-954193.1 | UCUAGGAAGAGCUGUACCGUA | 1864 | 3323-3343 | UACGGUACAGCTCTUCCUAGACU | 3119 | 3321-3343 |
| AD-954201.1 | CUUCUCUAAGTCCCAUCCGAA | 3001 | 3678-3698 | UTCGGATGGGACUTAGAGAAGGG | 3120 | 3676-3698 |
| AD-954209.1 | UUAGUCGAGAACCAAUGAUGA | 1866 | 4053-4073 | UCAUCAUGGUTCTCGACUAAAG | 3121 | 4051-4073 |
| AD-954217.1 | UCAUAAUCACAUUCGUUUGUA | 1707 | 4405-4425 | UACAAACGAAUGUGATUAUGAAU | 3122 | 4403-4425 |
| AD-954225.1 | UUCAGUUACGGGUUAAUUACA | 1708 | 4518-4538 | UGUAAUTAACCCGTAACUGAACC | 3123 | 4516-4538 |
| AD-954233.1 | ACUGUCUCGACAGAUAGCUGA | 1709 | 4966-4986 | UCAGCUAUCUGTCGAGACAGUCG | 3124 | 4964-4986 |
| AD-954241.1 | UUACGGAGTATGUUCGUCACA | 3002 | 5108-5128 | UGUGACGAACATACUCCGUAAAA | 3125 | 5106-5128 |
| AD-954249.1 | GCAACAUACUTUCUAUUGCCA | 3003 | 5452-5472 | UGGCAATAGAAAGTAUGUUGCUG | 3126 | 5450-5472 |
| AD-954257.1 | ACUCCGAGCACUUAACGUGGA | 1711 | 5886-5906 | UCCACGTUAAGTGCUCGGAGUCA | 3127 | 5884-5906 |
| AD-954264.1 | GCAAUUCAGUCUCGUUGUGAA | 1712 | 6017-6037 | UTCACAACGAGACTGAAUUGCCU | 3128 | 6015-6037 |
| AD-954272.1 | UGCCUUCATGAUGAACUCGGA | 3004 | 6547-6567 | UCCGAGUUCAUCATGAAGGCAUU | 3129 | 6545-6567 |
| AD-954280.1 | CAACAGCUACACACGUGUGCA | 1714 | 7366-7386 | UGCACACGUGUGUAGCUGUUGAC | 1875 | 7364-7386 |
| AD-954288.1 | GACGCUGACAGAACUGCGAAA | 1715 | 8317-8337 | UTUCGCAGUUCTGTCAGCGUCAC | 3130 | 8315-8337 |
| AD-954296.1 | CUGACUUGTUTACGAAAUGUA | 3005 | 9539-9559 | UACAUTUCGUAAACAAGUCAGCA | 3131 | 9537-9559 |
| AD-954218.1 | AUCACAUUCGUUGUUUGAAA | 3006 | 4410-4430 | UTUCAAACAAACGAATGUGAUUA | 3132 | 4408-4430 |
| AD-954226.1 | CAGUUACGGGTUAAUUACUGA | 3007 | 4520-4540 | UCAGTAAUUAACCCGTAACUGAA | 3133 | 4518-4540 |
| AD-954234.1 | AAGCCCUUGGAGUGUUAAAUA | 1719 | 5037-5057 | UAUUTAACACUCCAAGGGCUUCA | 3134 | 5035-5057 |
| AD-954242.1 | UCUGAUUUCCCAGUCAACUGA | 1720 | 5197-5217 | UCAGTUGACUGGGAAAUCAGAAC | 3135 | 5195-5217 |
| AD-954250.1 | AUCUUCAAGUCUGGAAUGUUA | 1721 | 5507-5527 | UAACAUTCCAGACTUGAAGAUGU | 3136 | 5505-5527 |
| AD-954258.1 | AUCCAGGCAATUCAGUCUCGA | 3008 | 6011-6031 | UCGAGACUGAAUUGCCUGGAUGA | 3137 | 6009-6031 |
| AD-954265.1 | AUGGUCGACATCCUUGCUUGA | 3009 | 6170-6190 | UCAAGCAAGGATGTCGACCAUGC | 3138 | 6168-6190 |
| AD-954273.1 | CUUCAUGATGAACUCGGAGUA | 3010 | 6550-6570 | UACUCCGAGUUCAUCAUGAAGGC | 3139 | 6548-6570 |

TABLE 14-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-954281.1 | GACCAGUCGUACUCAGUUUGA | 1725 | 7525-7545 | UCAAACTGAGUACGACUGGUCCA | 2655 | 7523-7545 |
| AD-954289.1 | ACGCUGACAGAACUGCGAAGA | 1726 | 8318-8338 | UCUUCGCAGUUCUGUCAGCGUCA | 1887 | 8316-8338 |
| AD-954297.1 | UGACUUGUTUACGAAAUGUCA | 3011 | 9540-9560 | UGACAUTUCGUAAACAAGUCAGC | 2660 | 9538-9560 |
| AD-954219.1 | UGUUUGAACCTCUUGUUAUAA | 3012 | 4422-4442 | UTAUAACAAGAGGUTCAAACAAA | 3140 | 4420-4442 |
| AD-954227.1 | UCAGAUCAGGTGUUUAUUGGA | 3013 | 4550-4570 | UCCAAUAAACACCTGAUCUGAAU | 3141 | 4548-4570 |
| AD-954235.1 | GCCCUUGGAGTGUUAAAUACA | 3014 | 5039-5059 | UGUATUTAACACUCCAAGGGCUU | 3142 | 5037-5059 |
| AD-954243.1 | AAGAUAUUGUTCUUUCUCGUA | 3015 | 5217-5237 | UACGAGAAAGAACAATAUCUUCA | 3143 | 5215-5237 |
| AD-954251.1 | UCAAGUCUGGAAUGUUCCGGA | 1730 | 5511-5531 | UCCGGAACAUUCCAGACUUGAAG | 1891 | 5509-5531 |
| AD-954259.1 | UCCAGGCAAUTCAGUCUCGUA | 3016 | 6012-6032 | UACGAGACUGAAUTGCCUGGAUG | 3144 | 6010-6032 |
| AD-954266.1 | GUCGACAUCCTUGCUUGUCGA | 3017 | 6173-6193 | UCGACAAGCAAGGAUGUCGACCA | 1893 | 6171-6193 |
| AD-954274.1 | CUGCUAGCTCCAUGCUUAAGA | 3018 | 6581-6601 | UCUUAAGCAUGGAGCTAGCAGGC | 3145 | 6579-6601 |
| AD-954282.1 | ACCAGUCGTACUCAGUUUGAA | 3019 | 7526-7546 | UTCAAACUGAGTACGACUGGUCC | 3146 | 7524-7546 |
| AD-954290.1 | GAAAGGAGAAAGUCAGUCCGA | 1735 | 8937-8957 | UCGGACTGACUTUCUCCUUUCCU | 3147 | 8935-8957 |
| AD-954298.1 | UAACGUAACUCUUUCUAUGCA | 1736 | 10173-10193 | UGCATAGAAAGAGTUACGUUAAA | 3148 | 10171-10193 |
| AD-954220.1 | GUUUGAACCUCUUGUUAUAAA | 123 | 4423-4443 | UTUATAACAAGAGGUTCAAACAA | 3149 | 4421-4443 |
| AD-954228.1 | UUGGCUUUGUAUUGAAACAGA | 1737 | 4566-4586 | UCUGTUTCAAUACAAAGCCAAUA | 3150 | 4564-4586 |
| AD-954236.1 | UAGACAUGCUTUUACGGAGUA | 3020 | 5097-5117 | UACUCCGUAAAAGCATGUCUACC | 3151 | 5095-5117 |
| AD-954244.1 | GAUAUUGUTCTUUCUCGUAUA | 3021 | 5219-5239 | UAUACGAGAAAGAACAAUAUCUU | 1900 | 5217-5239 |
| AD-954252.1 | CAAGUCUGGAAUGUUCCGGAA | 1740 | 5512-5532 | UTCCGGAACAUTCCAGACUUGAA | 3152 | 5510-5532 |
| AD-954260.1 | CCAGGCAAUTCAGUCUCGUUA | 3022 | 6013-6033 | UAACGAGACUGAATUGCCUGGAU | 3153 | 6011-6033 |
| AD-954267.1 | CAUGCAAGACTCACUUAGUCA | 3023 | 6349-6369 | UGACTAAGUGAGUCUTGCAUGGU | 3154 | 6347-6369 |
| AD-954275.1 | UGCUAGCUCCAUGCUUAAGCA | 1743 | 6582-6602 | UGCUTAAGCAUGGAGCUAGCAGG | 3155 | 6580-6602 |
| AD-954283.1 | CCAGUCGUACTCAGUUUGAAA | 3024 | 7527-7547 | UTUCAAACUGAGUACGACUGGUC | 3156 | 7525-7547 |
| AD-954291.1 | AGAACUUCAGACCCUAAUCCA | 1745 | 8960-8980 | UGGATUAGGGUCUGAAGUUCUAC | 3157 | 8958-8980 |
| AD-954299.1 | UCUAUGCCCGTGUAAAGUAUA | 3025 | 10186-10206 | UAUACUTUACACGGGCAUAGAAA | 3158 | 10184-10206 |
| AD-954221.1 | UUUGAACCTCTUGUUAUAAAA | 3026 | 4424-4444 | UTUUAUAACAAGAGGTUCAAACA | 3159 | 4422-4444 |
| AD-954229.1 | UUAUGAACGCTAUCAUUCAAA | 3027 | 4666-4686 | UTUGAATGAUAGCGUTCAUAAGA | 3160 | 4664-4686 |
| AD-954237.1 | ACAUGCUUTACGGAGUAUGA | 3028 | 5100-5120 | UCAUACTCCGUAAAAGCAUGUCU | 2635 | 5098-5120 |
| AD-954245.1 | UUGUUCUUTCTCGUAUUCAGA | 3029 | 5223-5243 | UCUGAATACGAGAAAGAACAAUA | 2637 | 5221-5243 |
| AD-954253.1 | AGCACAAAGUTACUUAGUCCA | 3030 | 5744-5764 | UGGACUAAGUAACTUTGUGCUGG | 3161 | 5742-5764 |
| AD-954261.1 | CAGGCAAUTCAGUCUCGUUGA | 3031 | 6014-6034 | UCAACGAGACUGAAUTGCCUGGA | 3162 | 6012-6034 |
| AD-954268.1 | AUGCAAGACUCACUUAGUCCA | 1752 | 6350-6370 | UGGACUAAGUGAGTCUTGCAUGG | 3163 | 6348-6370 |
| AD-954276.1 | ACUGGAGCAAGUUGAAUGAUA | 1753 | 6753-6773 | UAUCAUTCAACTUGCTCCAGUAG | 3164 | 6751-6773 |
| AD-954284.1 | CAGUCGUACUCAGUUUGAAGA | 120 | 7528-7548 | UCUUCAAACUGAGTACGACUGGU | 3165 | 7526-7548 |
| AD-954292.1 | UCAUGAACAAAGUCAUCGGAA | 1754 | 9129-9149 | UTCCGATGACUTUGUTCAUGAUG | 3166 | 9127-9149 |
| AD-954300.1 | CUAUGCCCGUGUAAAGUAUGA | 1755 | 10187-10207 | UCAUACTUUACACGGGCAUAGAA | 3167 | 10185-10207 |
| AD-954222.1 | AAGCUUUAAAACAGUACACGA | 1756 | 4443-4463 | UCGUGUACUGUTUTAAAGCUUUU | 3168 | 4441-4463 |

TABLE 14-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-954230.1 | AACGCUAUCAUCAAAACAGA | 3032 | 4671-4691 | UCUGUUUGAAUGAUAGCGUUCA | 3169 | 4669-4691 |
| AD-954238.1 | CUUUUACGGAGUAUGUUCGUA | 1758 | 5105-5125 | UACGAACAUACUCCGUAAAAGCA | 3170 | 5103-5125 |
| AD-954246.1 | UGUUCUUUCUCGUAUUCAGGA | 125 | 5224-5244 | UCCUGAAUACGAGAAAGAACAAU | 326 | 5222-5244 |
| AD-954254.1 | AGAGGAGGAUTCUGACUUGGA | 3033 | 5779-5799 | UCCAAGTCAGAAUCCUCCUCUUC | 3171 | 5777-5799 |
| AD-954262.1 | AGGCAAUUCAGUCUCGUUGUA | 1760 | 6015-6035 | UACAACGAGACTGAAUUGCCUGG | 3172 | 6013-6035 |
| AD-954269.1 | CACUGGAAACAGUGAGUCCGA | 1761 | 6417-6437 | UCGGACTCACUGUUUCCAGUGAC | 3173 | 6415-6437 |
| AD-954277.1 | UGUCAACAGCTACACACGUGA | 3034 | 7363-7383 | UCACGUGUGUAGCTGUUGACAAG | 3174 | 7361-7383 |
| AD-954285.1 | AAGCUGAGCAUUAUCAGAGGA | 3035 | 7787-7807 | UCCUCUGAUAAUGCUCAGCUUCC | 3175 | 7785-7807 |
| AD-954293.1 | CGGCUGCUGACUUGUUUACGA | 1764 | 9533-9553 | UCGUAAACAAGUCAGCAGCCGGU | 3176 | 9531-9553 |
| AD-954301.1 | CCGCUGACAUUCCGUUGUAA | 3036 | 10311-10331 | UUACAACGGAAAUGUCAGCGGGU | 3177 | 10309-10331 |
| AD-954223.1 | AGCUGGUUCAGUUACGGGUUA | 1766 | 4512-4532 | UAACCCGUAACTGAACCAGCUGC | 3178 | 4510-4532 |
| AD-954231.1 | GUGGAAGCGACUGUCUCGACA | 1767 | 4957-4977 | UGUCGAGACAGTCGCUUCCACUU | 3179 | 4955-4977 |
| AD-954239.1 | UUUUACGGAGTAUGUUCGUCA | 3037 | 5106-5126 | UGACGAACAUACUCCGUAAAAGC | 1929 | 5104-5126 |
| AD-954247.1 | AUUUUCAAGGTUUCUAUUACA | 3038 | 5368-5388 | UGUAAUAGAAACCUUGAAAAUGU | 3180 | 5366-5388 |
| AD-954255.1 | CAAUAGAGAAAUAGUACGAAA | 1769 | 5818-5838 | UUUCGUACUAUUUCUCUAUUGCA | 3181 | 5816-5838 |
| AD-954263.1 | GGCAAUUCAGTCUCGUUGUGA | 3039 | 6016-6036 | UCACAACGAGACUGAAUUGCCUG | 1931 | 6014-6036 |
| AD-954270.1 | AGCUGGUGAATCGGAUUCCUA | 3040 | 6513-6533 | UAGGAATCCGAUUCACCAGCUCU | 3182 | 6511-6533 |
| AD-954278.1 | GUCAACAGCUACACACGUGUA | 1772 | 7364-7384 | UACACGTGUGUAGCUGUUGACAA | 3183 | 7362-7384 |
| AD-954286.1 | UUGAGCUGAUGUAUGUGACGA | 1773 | 8301-8321 | UCGUCACAUACAUCAGCUCAAAC | 1934 | 8299-8321 |
| AD-954294.1 | GGCUGCUGACTUGUUUACGAA | 3041 | 9534-9554 | UUCGUAAACAAGUCAGCAGCCGG | 3184 | 9532-9554 |
| AD-954302.1 | GACUGUCAUGTGGCUUGGUUA | 3042 | 11080-11100 | UAACCAAGCCACAUGACAGUCGC | 3185 | 11078-11100 |
| AD-954224.1 | GUUCAGUUACGGGUUAAUUAA | 1775 | 4517-4537 | UUAAUUAACCCGUAACUGAACCA | 3186 | 4515-4537 |
| AD-954232.1 | GACUGUCUCGACAGAUAGCUA | 1776 | 4965-4985 | UAGCTATCUGUCGAGACAGUCGC | 3187 | 4963-4985 |
| AD-954240.1 | UUUACGGAGUAUGUUCGUCAA | 1777 | 5107-5127 | UUGACGAACAUACUCCGUAAAAG | 3188 | 5105-5127 |
| AD-954248.1 | AAGGUUUCTAUUACAACUGGA | 3043 | 5374-5394 | UCCAGUTGUAAUAGAAACCUUGA | 3189 | 5372-5394 |
| AD-954256.1 | GACUCCGAGCACUUAACGUGA | 1779 | 5885-5905 | UCACGUUAAGUGCUCGGAGUCAU | 3190 | 5883-5905 |
| AD-954271.1 | GCUGGUGAAUCGGAUUCCUGA | 1780 | 6514-6534 | UCAGGAAUCCGAUTCACCAGCUC | 3191 | 6512-6534 |
| AD-954279.1 | UCAACAGCTACACACGUGUGA | 3044 | 7365-7385 | UCACACGUGUGTAGCTGUUGACA | 3192 | 7363-7385 |
| AD-954287.1 | GAGCUGAUGUAUGUGACGCUA | 1782 | 8303-8323 | UAGCGUCACAUACAUCAGCUCAA | 1943 | 8301-8323 |
| AD-954295.1 | CUGCUGACTUGUUUACGAAAA | 3045 | 9536-9556 | UUUUCGUAAACAAGUCAGCAGCC | 3193 | 9534-9556 |

TABLE 15

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954123.1 | asgscua(Chd)cadAgdAaagaccgugaL96 | 3194 | VPusdCsacdGgdTcuuudCudTgdGuagcusgsa | 3374 | UCAGCUACCAAGAAAGACCGUGU | 2445 |

TABLE 15-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954131.1 | asusucu(Ahd)audCudTccaagguuaaL96 | 3195 | VPusdTsaadCcdTuggadAgdAudTagaauscsc | 3375 | GGAUUCUAAUCUUCCAAGGUUAC | 965 |
| AD-954139.1 | asgsguu(Uhd)audGadAcugacguuaaL96 | 3196 | VPusdTsaadCgdTcagudTcdAudAaaccusgsg | 3376 | CCAGGUUUAUGAACUGACGUUAC | 991 |
| AD-954147.1 | asgsuau(Uhd)gudGgdAacuuauagcaL96 | 3197 | VPusdGscudAudAaguudCcdAcdAauacuscsc | 3377 | GGAGUAUUGUGGAACUUAUAGCU | 2446 |
| AD-954155.1 | gsascuc(Uhd)gadAudCgagaucggaaL96 | 3198 | VPusdTsccdGadTcucgdAudTcdAgagucsasu | 3378 | AUGACUCUGAAUCGAGAUCGGAU | 2447 |
| AD-954163.1 | ascsagc(Ahd)gudGudTgauaaauuuaL96 | 3199 | VPusdAsaadTudTaucadAcdAcdTgcuguscsa | 3379 | UGACAGCAGUGUUGAUAAAUUUG | 1015 |
| AD-954170.1 | csgsccu(Uhd)uudAudCugcuucguuaL96 | 3200 | VPusdAsacdGadAgcagdAudAadAaggcgsgsa | 3380 | UCCGCCUUUUAUCUGCUUCGUUU | 1001 |
| AD-954178.1 | csusgag(Ghd)aadCadGuuccuauugaL96 | 3201 | VPusdCsaadTadGgaacdTgdTudCcucagsasg | 3381 | CUCUGAGGAACAGUUCCUAUUGG | 1021 |
| AD-954186.1 | ususcuc(Chd)gudCadGcacaauaacaL96 | 3202 | VPusdGsuudAudTgugcdTgdAcdGgagaasasu | 3382 | AUUUCUCCGUCAGCACAAUAACC | 3554 |
| AD-954194.1 | usasgga(Ahd)gadGcdTguaccguugaL96 | 3203 | VPusdCsaadCgdGuacadGcdTcdTuccuasgsa | 3383 | UCUAGGAAGAGCUGUACCGUUGG | 2448 |
| AD-954202.1 | ususcuc(Uhd)aadGudCccauccgacaL96 | 3204 | VPusdGsucdGgdAugggdAcdTudAgagaasgsg | 3384 | CCUUCUCUAAGUCCCAUCCGACG | 2449 |
| AD-954210.1 | ususgug(Uhd)ucdAadCaauuguugaaL96 | 3205 | VPusdTscadAcdAauugdTudGadAcacaasasc | 3385 | GUUUGUGUUCAACAAUUGUUGAA | 3555 |
| AD-954124.1 | csusacc(Ahd)agdAadAgaccgugugaL96 | 3206 | VPusdCsacdAcdGgucudTudCudTgguagscsu | 3386 | AGCUACCAAGAAAGACCGUGUGA | 2450 |
| AD-954132.1 | ususcca(Ahd)ggdTudAcagcucgagaL96 | 3207 | VPusdCsucdGadGcugudAadCcdTuggaasgsa | 3387 | UCUUCCAAGGUUACAGCUCGAGC | 2451 |
| AD-954140.1 | gsgsuuu(Ahd)ugdAadCugacguuacaL96 | 3208 | VPusdGsuadAcdGucagdTudCadTaaaccsusg | 3388 | CAGGUUUAUGAACUGACGUUACA | 2452 |
| AD-954148.1 | gsusauu(Ghd)ugdGadAcuuauagcuaL96 | 3209 | VPusdAsgcdTadTaagudTcdCadCaauacsusc | 3389 | GAGUAUUGUGGAACUUAUAGCUG | 2453 |
| AD-954156.1 | ascsucu(Ghd)aadTcdGagaucggauaL96 | 3210 | VPusdAsucdCgdAucucdGadTudCagaguscsa | 3390 | UGACUCUGAAUCGAGAUCGGAUG | 1011 |
| AD-954164.1 | usgsaua(Ahd)audTudGuguugagagaL96 | 3211 | VPusdCsucdTcdAacacdAadAudTuaucasasc | 3391 | GUUGAUAAAUUUGUGUUGAGAGA | 2454 |
| AD-954171.1 | uscsuau(Ahd)aadGudTccucuugacaL96 | 3212 | VPusdGsucdAadGaggadAcdTudTauagasgsu | 3392 | ACUCUAUAAAGUUCCUCUUGACA | 987 |
| AD-954179.1 | usgsagg(Ahd)acdAgdTuccuauuggaL96 | 3213 | VPusdCscadAudAggaadCudGudTccucasgsa | 3393 | UCUGAGGAACAGUUCCUAUUGGC | 2455 |
| AD-954187.1 | uscsucc(Ghd)ucdAgdCacaauaaccaL96 | 3214 | VPusdGsgudTadTugugdCudGadCggagasasa | 3394 | UUUCUCCGUCAGCACAAUAACCA | 2456 |
| AD-954195.1 | asgsgaa(Ghd)agdCudGuaccguuggaL96 | 3215 | VPusdCscadAcdGguacdAgdCudCuuccusasg | 3395 | CUAGGAAGAGCUGUACCGUUGGG | 2457 |
| AD-954203.1 | gsasgaa(Chd)aadGcdAucuguaccgaL96 | 3216 | VPusdCsggdTadCagaudGcdTudGuucucscsu | 3396 | AGGAGAACAAGCAUCUGUACCGU | 2458 |
| AD-954211.1 | gsasgug(Uhd)cadCadAagaaccgugaL96 | 3217 | VPusdCsacdGgdTucuudTgdTgdAcacucsgsu | 3397 | ACGAGUGUCACAAAGAACCGUGC | 2459 |
| AD-954125.1 | asasuca(Uhd)ugdTcdTgacaauaugaL96 | 3218 | VPusdCsaudAudTgucadGadCadAugauuscsa | 3398 | UGAAUCAUUGUCUGACAAUAUGU | 2460 |
| AD-954133.1 | uscscaa(Ghd)gudTadCagcucgagcaL96 | 3219 | VPusdGscudCgdAgcugdTadAcdCuuggasasg | 3399 | CUUCCAAGGUUACAGCUCGAGCU | 2461 |

TABLE 15-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954141.1 | ususuau(Ghd)aadCudGacguuacauaL96 | 3220 | VPusdAsugdTadAcgucdAgdTudCauaaascsc | 3400 | GGUUUAUGAACUGACGUUACAUC | 2462 |
| AD-954149.1 | usasuug(Uhd)ggdAadCuuauagcugaL96 | 3221 | VPusdCsagdCudAuaagdTudCcdAcaauascsu | 3401 | AGUAUUGUGGAACUUAUAGCUGG | 2463 |
| AD-954157.1 | csuscug(Ahd)audCgdAgaucggaugaL96 | 3222 | VPusdCsaudCcdGaucudCgdAudTcagagsusc | 3402 | GACUCUGAAUCGAGAUCGGAUGU | 2464 |
| AD-954165.1 | asgsaug(Ahd)agdCudAcugaaccggaL96 | 3223 | VPusdCscgdGudTcagudAgdCudTcaucuscsu | 3403 | AGAGAUGAAGCUACUGAACCGGG | 2465 |
| AD-954172.1 | csasucu(Uhd)gadAcdTacaucgaucaL96 | 3224 | VPusdGsaudCgdAuguadGudTcdAagaugsusc | 3404 | GACAUCUUGAACUACAUCGAUCA | 2466 |
| AD-954180.1 | gsasgga(Ahd)cadGudTccuauuggcaL96 | 3225 | VPusdGsccdAadTaggadAcdTgdTuccucsasg | 3405 | CUGAGGAACAGUUCCUAUUGGCU | 2921 |
| AD-954188.1 | uscscgu(Chd)agdCadCaauaaccagaL96 | 3226 | VPusdCsugdGudTauugdTgdCudGacggasgsa | 3406 | UCUCCGUCAGCACAAUAACCAGA | 2467 |
| AD-954196.1 | gsgsaag(Ahd)gcdTgdTaccguugggaL96 | 3227 | VPusdCsccdAadCgguadCadGcdTcuuccsusa | 3407 | UAGGAAGAGCUGUACCGUUGGGA | 2468 |
| AD-954204.1 | asascaa(Ghd)cadTcdTguaccguugaL96 | 3228 | VPusdCsaadCgdGuacadGadTgdCuuguuscsu | 3408 | AGAACAAGCAUCUGUACCGUUGA | 2924 |
| AD-954212.1 | usgsuca(Chd)aadAgdAaccgugcagaL96 | 3229 | VPusdCsugdCadCgguudCudTudGugacascsu | 3409 | AGUGUCACAAAGAACCGUGCAGA | 2469 |
| AD-954126.1 | csasuug(Uhd)cudGadCaauaugugaaL96 | 3230 | VPusdTscadCadTauugdTcdAgdAcaaugsasu | 3410 | AUCAUUGUCUGACAAUAUGUGAA | 925 |
| AD-954134.1 | csusguu(Chd)ccdAadAauuauggcuaL96 | 3231 | VPusdAsgcdCadTaauudTudGgdGaacagscsu | 3411 | AGCUGUUCCCAAAAUUAUGGCUU | 2470 |
| AD-954142.1 | csasgca(Chd)cadAgdAccacaauguaL96 | 3232 | VPusdAscadTudGuggudCudTgdGugcugsusg | 3412 | CACAGCACCAAGACCACAAUGUU | 2471 |
| AD-954150.1 | asusugu(Ghd)gadAcdTuauagcuggaL96 | 3233 | VPusdCscadGcdTauaadGudTcdCacaausasc | 3413 | GUAUUGUGGAACUUAUAGCUGGA | 2472 |
| AD-954158.1 | ususcug(Ahd)aadTudGuguuagacgaL96 | 3234 | VPusdCsgudCudAacacdAadTudTcagaascsu | 3414 | AGUUCUGAAAUUGUGUUAGACGG | 2473 |
| AD-954166.1 | cscsucu(Uhd)gudCcdAuugugucegaL96 | 3235 | VPusdCsggdAcdAcaaudGgdAcdAagaggsusg | 3415 | CACCUCUUGUCCAUUGUGUCCGC | 2474 |
| AD-954173.1 | csusuga(Ahd)cudAcdAucgaucaugaL96 | 3236 | VPusdCsaudGadTcgaudGudAgdTucaagsasu | 3416 | AUCUUGAACUACAUCGAUCAUGG | 930 |
| AD-954181.1 | asasgaa(Chd)gadGudGcucaauaauaL96 | 3237 | VPusdAsuudAudTgagcdAcdTcdGuucuusgsc | 3417 | GCAAGAACGAGUGCUCAAUAAUG | 2475 |
| AD-954189.1 | asasccu(Uhd)ucdAadGaguuauugcaL96 | 3238 | VPusdGscadAudAacucdTudGadAagguusasu | 3418 | AUAACCUUUCAAGAGUUAUUGCA | 2476 |
| AD-954197.1 | gsuscag(Chd)uudGgdTucccauuggaL96 | 3239 | VPusdCscadAudGggaadCcdAadGcugacsgsa | 3419 | UCGUCAGCUUGGUUCCCAUUGGA | 2477 |
| AD-954205.1 | cscsuga(Ahd)audCcdTgcuuuagucaL96 | 3240 | VPusdGsacdTadAagcadGgdAudTucaggsusa | 3420 | UACCUGAAAUCCUGCUUUAGUCG | 924 |
| AD-954213.1 | usasaga(Ahd)ugdCudAuucauaaucaL96 | 3241 | VPusdGsaudTadTgaaudAgdCadTucuuasusc | 3421 | GAUAAGAAUGCUAUUCAUAAUCA | 2478 |
| AD-954127.1 | asasugc(Chd)ucdAadCaaaguuaucaL96 | 3242 | VPusdGsaudAadCuuugdTudGadGgcauuscsg | 3422 | CGAAUGCCUCAACAAAGUUAUCA | 2479 |
| AD-954135.1 | asgsgcc(Uhd)ucdAudAgcgaaccugaL96 | 3243 | VPusdCsagdGudTcgcudAudGadAggccususu | 3423 | AAAGGCCUUCAUAGCGAACCUGA | 2480 |

TABLE 15-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954143.1 | gscsacc(Ahd)agdAcdCacaauguugaL96 | 3244 | VPusdCsaadCadTugugdGudCudTggugcsusg | 3424 | CAGCACCAAGACCACAAUGUUGU | 2481 |
| AD-954151.1 | usgsgag(Ghd)audGadCucugaaucgaL96 | 3245 | VPusdCsgadTudCagagdTcdAudCcuccasasg | 3425 | CUUGGAGGAUGACUCUGAAUCGA | 2482 |
| AD-954159.1 | uscsuga(Ahd)audTgdTguuagacggaL96 | 3246 | VPusdCscgdTcdTaacadCadAudTucagasasc | 3426 | GUUCUGAAAUUGUGUUAGACGGU | 959 |
| AD-954167.1 | csuscuu(Ghd)ucdCadTuguguccgcaL96 | 3247 | VPusdGscgdGadCacaadTgdGadCaagagsgsu | 3427 | ACCUCUUGUCCAUUGUGUCCGCC | 2483 |
| AD-954174.1 | ususgaa(Chd)uadCadTcgaucauggaL96 | 3248 | VPusdCscadTgdAucgadTgdTadGuucaasgsa | 3428 | UCUUGAACUACAUCGAUCAUGGA | 1017 |
| AD-954182.1 | gsasgug(Chd)ucdAadTaauguugucaL96 | 3249 | VPusdGsacdAadCauuadTudGadGcacucsgsu | 3429 | ACGAGUGCUCAAUAAUGUUGUCA | 2484 |
| AD-954190.1 | asgsuuu(Ghd)cadTudTggaguuuagaL96 | 3250 | VPusdCsuadAadCuccadAadTgdCaaacusgsg | 3430 | CCAGUUUGCAUUUGGAGUUUAGG | 2485 |
| AD-954198.1 | asgscuu(Ghd)gudTcdCcauuggaucaL96 | 3251 | VPusdGsaudCcdAauggdGadAcdCaagcusgsa | 3431 | UCAGCUUGGUUCCCAUUGGAUCU | 2486 |
| AD-954206.1 | csusgaa(Ahd)ucdCudGcuuuagucgaL96 | 3252 | VPusdCsgadCudAaagcdAgdGadTuucagsgsu | 3432 | ACCUGAAAUCCUGCUUUAGUCGA | 2487 |
| AD-954214.1 | asgsaau(Ghd)cudAudTcauaaucacaL96 | 3253 | VPusdGsugdAudTaugadAudAgdCauucususa | 3433 | UAAGAAUGCUAUUCAUAAUCACA | 921 |
| AD-954128.1 | ususauc(Ahd)aadGcdTuugauggauaL96 | 3254 | VPusdAsucdCadTcaaadGcdTudTgauaascsu | 3434 | AGUUAUCAAAGCUUUGAUGGAUU | 2488 |
| AD-954136.1 | csuscug(Chd)ugdAudTcuuggcgugaL96 | 3255 | VPusdCsacdGcdCaagadAudCadGcagagsusg | 3435 | CACUCUGCUGAUUCUUGGCGUGC | 2489 |
| AD-954144.1 | csascca(Ahd)gadCcdAcaauguuguaL96 | 3256 | VPusdAscadAcdAuugudGgdTcdTuggugcsu | 3436 | AGCACCAAGACCACAAUGUUGUG | 2490 |
| AD-954152.1 | gsasgga(Uhd)gadCudCugaaucgagaL96 | 3257 | VPusdCsucdGadTucagdAgdTcdAuccucscsa | 3437 | UGGAGGAUGACUCUGAAUCGAGA | 2491 |
| AD-954160.1 | csusgaa(Ahd)uudGudGuuagacgguaL96 | 3258 | VPusdAsccdGudCuaacdAcdAadTuucagsasa | 3438 | UUCUGAAAUUGUGUUAGACGGUA | 971 |
| AD-954168.1 | uscscgc(Chd)uudTudAucugcuucgaL96 | 3259 | VPusdCsgadAgdCagaudAadAadGgcggascsa | 3439 | UGUCCGCCUUUUAUCUGCUUCGU | 2492 |
| AD-954175.1 | gsasacu(Ahd)cadTcdGaucauggagaL96 | 3260 | VPusdCsucdCadTgaucdGadTgdTaguucsasa | 3440 | UUGAACUACAUCGAUCAUGGAGA | 2493 |
| AD-954183.1 | gscscuc(Chd)audCudCauuucuccgaL96 | 3261 | VPusdCsggdAgdAaaugdAgdAudGgaggcsusg | 3441 | CAGCCUCCAUCUCAUUUCUCCGU | 2494 |
| AD-954191.1 | gsusuug(Chd)audTudGgaguuuaggaL96 | 3262 | VPusdCscudAadAcuccdAadAudGcaaacsusg | 3442 | CAGUUUGCAUUUGGAGUUUAGGU | 2495 |
| AD-954199.1 | asgsaug(Chd)uudTgdAuuuuggccgaL96 | 3263 | VPusdCsggdCcdAaaaudCadAadGcaucusug | 3443 | CAAGAUGCUUUGAUUUUGGCCGG | 2496 |
| AD-954207.1 | gsasaau(Chd)cudGcdTuuagucgagaL96 | 3264 | VPusdCsucdGadCuaaadGcdAgdGauuucsasg | 3444 | CUGAAAUCCUGCUUUAGUCGAGA | 2497 |
| AD-954215.1 | gscsuau(Uhd)cadTadAucacauucgaL96 | 3265 | VPusdCsgadAudGugaudTadTgdAauagcsasu | 3445 | AUGCUAUUCAUAAUCACAUUCGU | 988 |
| AD-954129.1 | gscsuuu(Ghd)audGgdAuucuaaucuaL96 | 3266 | VPusdAsgadTudAgaaudCcdAudCaaagcsusu | 3446 | AAGCUUUGAUGGAUUCUAAUCUU | 946 |
| AD-954137.1 | gscsagc(Uhd)ugdTcdCagguuuaugaL96 | 3267 | VPusdCsaudAadAccugdGadCadAgcugcsusc | 3447 | GAGCAGCUUGUCCAGGUUUAUGA | 2498 |
| AD-954145.1 | ascscaa(Ghd)acdCadCaauguugugaL96 | 3268 | VPusdCsacdAadCauugdTgdGudCuuggusgsc | 3448 | GCACCAAGACCACAAUGUUGUGA | 2499 |

TABLE 15-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954153.1 | asgsgau(Ghd)acdTcdTgaaucgagaaL96 | 3269 | VPusdTscudCgdAuucadGadGudCauccuscsc | 3449 | GGAGGAUGACUCUGAAUCGAGAU | 2500 |
| AD-954161.1 | usgsaaa(Uhd)ugdTgdTuagacgguaaL96 | 3270 | VPusdTsacdCgdTcuaadCadCadAuuucasgsa | 3450 | UCUGAAAUUGUGUUAGACGGUAC | 1003 |
| AD-954169.1 | cscsgcc(Uhd)uudTadTcugcuucguaL96 | 3271 | VPusdAscgdAadGcagadTadAadAggcggsasc | 3451 | GUCCGCCUUUUAUCUGCUUCGUU | 2501 |
| AD-954176.1 | csusuug(Ghd)cgdGadTugcauuccuaL96 | 3272 | VPusdAsggdAadTgcaadTcdCgdCcaaagsasa | 3452 | UUCUUUGGCGGAUUGCAUUCCUU | 2502 |
| AD-954184.1 | cscsucc(Ahd)ucdTcdAuuucuccguaL96 | 3273 | VPusdAscgdGadGaaaudGadGadTggaggscsu | 3453 | AGCCUCCAUCUCAUUUCUCCGUC | 2503 |
| AD-954192.1 | gsuscua(Ghd)gadAgdAgcuguaccgaL96 | 3274 | VPusdCsggdTadCagcudCudTcdCuagacsusc | 3454 | GAGUCUAGGAAGAGCUGUACCGU | 2504 |
| AD-954200.1 | gsgsccg(Ghd)aadAcdTugcuugcagaL96 | 3275 | VPusdCsugdCadAgcaadGudTudCcggccsasa | 3455 | UUGGCCGGAAACUUGCUUGCAGC | 2505 |
| AD-954208.1 | ususuag(Uhd)cgdAgdAaccaaugauaL96 | 3276 | VPusdAsucdAudTgguudCudCgdAcuaaasgsc | 3456 | GCUUUAGUCGAGAACCAAUGAUG | 2506 |
| AD-954216.1 | ususcau(Ahd)audCadCauucguuugaL96 | 3277 | VPusdCsaadAcdGaaugdTgdAudTaugaasusa | 3457 | UAUUCAUAAUCACAUUCGUUUGU | 972 |
| AD-954130.1 | gsasuuc(Uhd)aadTcdTuccaagguuaL96 | 3278 | VPusdAsacdCudTggaadGadTudAgaaucscsa | 3458 | UGGAUUCUAAUCUUCCAAGGUUA | 952 |
| AD-954138.1 | csasggu(Uhd)uadTgdAacugacguuaL96 | 3279 | VPusdAsacdGudCaguudCadTadAaccugsgsa | 3459 | UCCAGGUUUAUGAACUGACGUUA | 964 |
| AD-954146.1 | gsasgua(Uhd)ugdTgdGaacuuauagaL96 | 3280 | VPusdCsuadTadAguucdCadCadAuacucscsc | 3460 | GGGAGUAUUGUGGAACUUAUAGC | 998 |
| AD-954154.1 | gsgsaug(Ahd)cudCudGaaucgagauaL96 | 3281 | VPusdAsucdTcdGauucdAgdAgdTcauccsusc | 3461 | GAGGAUGACUCUGAAUCGAGAUC | 2507 |
| AD-954162.1 | gsasaau(Uhd)gudGudTagacgguacaL96 | 3282 | VPusdGsuadCcdGucuadAcdAcdAauuucsasg | 3462 | CUGAAAUUGUGUUAGACGGUACC | 2508 |
| AD-954177.1 | ususugg(Chd)ggdAudTgcauuccuuaL96 | 3283 | VPusdAsagdGadAugcadAudCcdGccaaasgsa | 3463 | UCUUUGGCGGAUUGCAUUCCUUU | 2509 |
| AD-954185.1 | csuscca(Uhd)cudCadTuucuccgucaL96 | 3284 | VPusdGsacdGgdAgaaadTgdAgdAuggagsgsc | 3464 | GCCUCCAUCUCAUUUCUCCGUCA | 2510 |
| AD-954193.1 | uscsuag(Ghd)aadGadGcuguaccguaL96 | 3285 | VPusdAscgdGudAcagcdTcdTudCcuagascsu | 3465 | AGUCUAGGAAGAGCUGUACCGUU | 2511 |
| AD-954201.1 | csusucu(Chd)uadAgdTcccauccgaaL96 | 3286 | VPusdTscgdGadTgggadCudTadGagaagsgsg | 3466 | CCCUUCUCUAAGUCCCAUCCGAC | 2512 |
| AD-954209.1 | ususagu(Chd)gadGadAccaaugaugaL96 | 3287 | VPusdCsaudCadTuggudTcdTcdGacuaasasg | 3467 | CUUUAGUCGAGAACCAAUGAUGG | 2513 |
| AD-954217.1 | uscsaua(Ahd)ucdAcdAuucguuuguaL96 | 3288 | VPusdAscadAadCgaaudGudGadTuaugasasu | 3468 | AUUCAUAAUCACAUUCGUUUGUU | 984 |
| AD-954225.1 | ususcag(Uhd)uadCgdGguuaauuacaL96 | 3289 | VPusdGsuadAudTaaccdCgdTadAcugaascsc | 3469 | GGUUCAGUUACGGUUAAUUACU | 1007 |
| AD-954233.1 | ascsugu(Chd)ucdGadCagauagcugaL96 | 3290 | VPusdCsagdCudAucugdTcdGadGacaguscsg | 3470 | CGACUGUCUCGACAGAUAGCUGA | 2379 |
| AD-954241.1 | ususacg(Ghd)agdTadTguucgucacaL96 | 3291 | VPusdGsugdAcdGaacadTadCudCcguaasasa | 3471 | UUUUACGGAGUAUGUUCGUCACU | 2380 |
| AD-954249.1 | gscsaac(Ahd)uadCudTucuauugccaL96 | 3292 | VPusdGsgcdAadTagaadAgdTadTguugcsusg | 3472 | CAGCAACAUACUUUCUAUUGCCA | 993 |

TABLE 15-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954257.1 | ascsucc(Ghd)agdCadCuuaacguggaL96 | 3293 | VPusdCscadCgdTuaagdTgdCudCggaguscsa | 3473 | UGACUCCGAGCACUUAACGUGGC | 2381 |
| AD-954264.1 | gscsaau(Uhd)cadGudCucguugugaaL96 | 3294 | VPusdTscadCadAcgagdAcdTgdAauugcscsu | 3474 | AGGCAAUUCAGUCUCGUUGUGAA | 2382 |
| AD-954272.1 | usgsccu(Uhd)cadTgdAugaacucggaL96 | 3295 | VPusdCscgdAgdTucaudCadTgdAaggcasusu | 3475 | AAUGCCUUCAUGAUGAACUCGGA | 2383 |
| AD-954280.1 | csasaca(Ghd)cudAcdAcacgugugcaL96 | 3296 | VPusdGscadCadCgugudGudAgdCuguugsasc | 3476 | GUCAACAGCUACACACGUGUGCC | 2384 |
| AD-954288.1 | gsascgc(Uhd)gadCadGaacugcgaaaL96 | 3297 | VPusdTsucdGcdAguucdTgdTcdAgcgucsasc | 3477 | GUGACGCUGACAGAACUGCGAAG | 2385 |
| AD-954296.1 | csusgac(Uhd)ugdTudTacgaaauguaL96 | 3298 | VPusdAscadTudTcguadAadCadAgucagscsa | 3478 | UGCUGACUUGUUUACGAAAUGUC | 2386 |
| AD-954218.1 | asuscac(Ahd)uudCgdTuuguuugaaaL96 | 3299 | VPusdTsucdAadAcaaadCgdAadTgugaususa | 3479 | UAAUCACAUUCGUUUGUUUGAAC | 2387 |
| AD-954226.1 | csasguu(Ahd)cgdGgdTuaauuacugaL96 | 3300 | VPusdCsagdTadAuuaadCcdCgdTaacugsasa | 3480 | UUCAGUUACGGGUUAAUUACUGU | 2388 |
| AD-954234.1 | asasgcc(Chd)uudGgdAguguuaaauaL96 | 3301 | VPusdAsuudTadAcacudCcdAadGggcuuscsa | 3481 | UGAAGCCCUUGGAGUGUUAAAUA | 2389 |
| AD-954242.1 | uscsuga(Uhd)uudCcdCagucaacugaL96 | 3302 | VPusdCsagdTudGacugdGgdAadAucagasasc | 3482 | GUUCUGAUUUCCCAGUCAACUGA | 2390 |
| AD-954250.1 | asuscuu(Chd)aadGudCuggaauguuaL96 | 3303 | VPusdAsacdAudTccagdAcdTudGaagausgsu | 3483 | ACAUCUUCAAGUCUGGAAUGUUC | 1004 |
| AD-954258.1 | asuscca(Ghd)gcdAadTucagucucgaL96 | 3304 | VPusdCsgadGadCugaadTudGcdCuggausgsa | 3484 | UCAUCCAGGCAAUUCAGUCUCGU | 2391 |
| AD-954265.1 | asusggu(Chd)gadCadTccuugcuugaL96 | 3305 | VPusdCsaadGcdAaggadTgdTcdGaccausgsc | 3485 | GCAUGGUCGACAUCCUUGCUUGU | 2392 |
| AD-954273.1 | csusuca(Uhd)gadTgdAacucggaguaL96 | 3306 | VPusdAscudCcdGaguudCadTcdAugaagsgsc | 3486 | GCCUUCAUGAUGAACUCGGAGUU | 2393 |
| AD-954281.1 | gsascca(Ghd)ucdGudAcucaguuugaL96 | 3307 | VPusdCsaadAcdTgagudAcdGadCuggucscsa | 3487 | UGGACCAGUCGUACUCAGUUUGA | 2394 |
| AD-954289.1 | ascsgcu(Ghd)acdAgdAacugcgaagaL96 | 3308 | VPusdCsuudCgdCaguudCudGudCagcguscsa | 3488 | UGACGCUGACAGAACUGCGAAGG | 2395 |
| AD-954297.1 | usgsacu(Uhd)gudTudAcgaaaugucaL96 | 3309 | VPusdGsacdAudTucgudAadAcdAagucasgsc | 3489 | GCUGACUUGUUUACGAAAUGUCC | 950 |
| AD-954219.1 | usgsuuu(Ghd)aadCcdTcuuguuauaaL96 | 3310 | VPusdTsaudAadCaagadGgdTudCaaacasasa | 3490 | UUUGUUUGAACCUCUUGUUAUAA | 933 |
| AD-954227.1 | uscsaga(Uhd)cadGgdTguuuauuggaL96 | 3311 | VPusdCscadAudAaacadCcdTgdAucugasasu | 3491 | AUUCAGAUCAGGUGUUUAUUGGC | 2396 |
| AD-954235.1 | gscsccu(Uhd)ggdAgdTguuaaauacaL96 | 3312 | VPusdGsuadTudTaacadCudCcdAagggcsusu | 3492 | AAGCCCUUGGAGUGUUAAAUACA | 2397 |
| AD-954243.1 | asasgau(Ahd)uudGudTcuuucucguaL96 | 3313 | VPusdAscgdAgdAaagadAcdAadTaucuuscsa | 3493 | UGAAGAUAUUGUUCUUUCUCGUA | 919 |
| AD-954251.1 | uscsaag(Uhd)cudGgdAauguuccggaL96 | 3314 | VPusdCscgdGadAcauudCcdAgdAcuugasasg | 3494 | CUUCAAGUCUGGAAUGUUCCGGA | 2398 |
| AD-954259.1 | uscscag(Ghd)cadAudTcagucucguaL96 | 3315 | VPusdAscgdAgdAcugadAudTgdCcuggasusg | 3495 | CAUCCAGGCAAUUCAGUCUCGU | 2399 |
| AD-954266.1 | gsuscga(Chd)audCcdTugcuugucgaL96 | 3316 | VPusdCsgadCadAgcaadGgdAudGucgacscsa | 3496 | UGGUCGACAUCCUUGCUUGUCGC | 2400 |
| AD-954274.1 | csusgcu(Ahd)gcdTcdCaugcuuaagaL96 | 3317 | VPusdCsuudAadGcaugdGadGcdTagcagsgsc | 3497 | GCCUGCUAGCUCCAUGCUUAAGC | 2401 |

TABLE 15-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954282.1 | ascscag(Uhd)cgdTadCucaguuugaaL96 | 3318 | VPusdTscadAadCugagdTadCgdAcugguscsc | 3498 | GGACCAGUCGUACUCAGUUUGAA | 2402 |
| AD-954290.1 | gsasaag(Ghd)agdAadAgucaguccgaL96 | 3319 | VPusdCsggdAcdTgacudTudCudCcuuucscsu | 3499 | AGGAAAGGAGAAAGUCAGUCCGG | 2403 |
| AD-954298.1 | usasacg(Uhd)aadCudCuuucuaugcaL96 | 3320 | VPusdGscadTadGaaagdAgdTudAcguuasasa | 3500 | UUUAACGUAACUCUUUCUAUGCC | 982 |
| AD-954220.1 | gsusuug(Ahd)acdCudCuuguuauaaaL96 | 3321 | VPusdTsuadTadAcaagdAgdGudTcaaacsasa | 3501 | UUGUUUGAACCUCUUGUUAUAAA | 929 |
| AD-954228.1 | ususggc(Uhd)uudGudAuugaaacagaL96 | 3322 | VPusdCsugdTudTcaaudAcdAadAgccaasusa | 3502 | UAUUGGCUUUGUAUUGAAACAGU | 2404 |
| AD-954236.1 | usasgac(Ahd)ugdCudTuuacggaguaL96 | 3323 | VPusdAscudCcdGuaaadAgdCadTgucuascsc | 3503 | GGUAGACAUGCUUUUACGGAGUA | 2405 |
| AD-954244.1 | gsasuau(Uhd)gudTcdTuucucguauaL96 | 3324 | VPusdAsuadCgdAgaaadGadAcdAauaucsusu | 3504 | AAGAUAUUGUUCUUUCUCGUAUU | 999 |
| AD-954252.1 | csasagu(Chd)ugdGadAuguuccggaaL96 | 3325 | VPusdTsccdGgdAacaudTcdCadGacuugsasa | 3505 | UUCAAGUCUGGAAUGUUCCGGAG | 2406 |
| AD-954260.1 | cscsagg(Chd)aadTudCagucucguuaL96 | 3326 | VPusdAsacdGadGacugdAadTudGccuggsasu | 3506 | AUCCAGGCAAUUCAGUCUCGUUG | 2407 |
| AD-954267.1 | csasugc(Ahd)agdAcdTcacuuagucaL96 | 3327 | VPusdGsacdTadAgugadGudCudTgcaugsgsu | 3507 | ACCAUGCAAGACUCACUUAGUCC | 1008 |
| AD-954275.1 | usgscua(Ghd)cudCcdAugcuuaagcaL96 | 3328 | VPusdGscudTadAgcaudGgdAgdCuagcasgsg | 3508 | CCUGCUAGCUCCAUGCUUAAGCC | 2408 |
| AD-954283.1 | cscsagu(Chd)gudAcdTcaguuugaaaL96 | 3329 | VPusdTsucdAadAcugadGudAcdGacuggsusc | 3509 | GACCAGUCGUACUCAGUUUGAAG | 958 |
| AD-954291.1 | asgsaac(Uhd)ucdAgdAcccuaauccaL96 | 3330 | VPusdGsgadTudAgggudCudGadAguucusasc | 3510 | GUAGAACUUCAGACCCUAAUCCU | 2409 |
| AD-954299.1 | uscsuau(Ghd)ccdCgdTguaaaguauaL96 | 3331 | VPusdAsuadCudTuacadCgdGgdCauagasasa | 3511 | UUUCUAUGCCCGUGUAAAGUAUG | 2410 |
| AD-954221.1 | ususuga(Ahd)ccdTcdTuguuauaaaaL96 | 3332 | VPusdTsuudAudAacaadGadGgdTucaaascsa | 3512 | UGUUUGAACCUCUUGUUAUAAAA | 928 |
| AD-954229.1 | ususaug(Ahd)acdGcdTaucauucaaaL96 | 3333 | VPusdTsugdAadTgauadGcdGudTcauaasgsa | 3513 | UCUUAUGAACGCUAUCAUUCAAA | 2411 |
| AD-954237.1 | ascsaug(Chd)uudTudAcggaguaugaL96 | 3334 | VPusdCsaudAcdTccgudAadAadGcauguscsu | 3514 | AGACAUGCUUUUACGGAGUAUGU | 2412 |
| AD-954245.1 | ususguu(Chd)uudTcdTcguauucagaL96 | 3335 | VPusdCsugdAadTacgadGadAadGaacaasusa | 3515 | UAUUGUUCUUUCUCGUAUUCAGG | 916 |
| AD-954253.1 | asgscac(Ahd)aadGudTacuuaguccaL96 | 3336 | VPusdGsgadCudAaguadAcdTudTgugcusgsg | 3516 | CCAGCACAAAGUUACUUAGUCCC | 2413 |
| AD-954261.1 | csasggc(Ahd)audTcdAgucucguugaL96 | 3337 | VPusdCsaadCgdAgacudGadAudTgccugsgsa | 3517 | UCCAGGCAAUUCAGUCUCGUUGU | 2414 |
| AD-954268.1 | asusgca(Ahd)gadCudCacuuaguccaL96 | 3338 | VPusdGsgadCudAagugdAgdTcdTugcausgsg | 3518 | CCAUGCAAGACUCACUUAGUCCC | 2415 |
| AD-954276.1 | ascsugg(Ahd)gcdAadGuugaaugauaL96 | 3339 | VPusdAsucdAudTcaacdTudGcdTccagusasg | 3519 | CUACUGGAGCAAGUUGAAUGAUC | 2416 |
| AD-954284.1 | csasguc(Ghd)uadCudCaguuugaagaL96 | 3340 | VPusdCsuudCadAacugdAgdTadCgacugsgsu | 3520 | ACCAGUCGUACUCAGUUUGAAGA | 926 |
| AD-954292.1 | uscsaug(Ahd)acdAadAgucaucggaaL96 | 3341 | VPusdTsccdGadTgacudTudGudTcaugasusg | 3521 | CAUCAUGAACAAAGUCAUCGGAG | 2417 |

TABLE 15-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954300.1 | csusaug(Chd)ccdGudGuaaaguaugaL96 | 3342 | VPusdCsaudAcdTuuacdAcdGgdGcauagsasa | 3522 | UUCUAUGCCCGUGUAAAGUAUGU | 2418 |
| AD-954222.1 | asasgcu(Uhd)uadAadAcaguacacgaL96 | 3343 | VPusdCsgudGudAcugudTudTadAagcuususu | 3523 | AAAAGCUUUAAAACAGUACACGA | 2419 |
| AD-954230.1 | asascgc(Uhd)audCadTucaaaacagaL96 | 3344 | VPusdCsugdTudTugaadTgdAudAgcguuscsa | 3524 | UGAACGCUAUCAUUCAAAACAGA | 2420 |
| AD-954238.1 | csusuuu(Ahd)cgdGadGuauguucguaL96 | 3345 | VPusdAscgdAadCauacdTcdCgdTaaaagscsa | 3525 | UGCUUUUACGGAGUAUGUUCGUC | 2421 |
| AD-954246.1 | usgsuuc(Uhd)uudCudCguauucaggaL96 | 3346 | VPusdCscudGadAuacgdAgdAadAgaacasasu | 3526 | AUUGUUCUUUCUCGUAUUCAGGA | 931 |
| AD-954254.1 | asgsagg(Ahd)ggdAudTcugacuuggaL96 | 3347 | VPusdCscadAgdTcagadAudCcdTccucususc | 3527 | GAAGAGGAGGAUUCUGACUUGGC | 2422 |
| AD-954262.1 | asgsgca(Ahd)uudCadGucucguuguaL96 | 3348 | VPusdAscadAcdGagacdTgdAadTugccusgsg | 3528 | CCAGGCAAUUCAGUCUCGUUGUG | 2423 |
| AD-954269.1 | csascug(Ghd)aadAcdAgugaguccgaL96 | 3349 | VPusdCsggdAcdTcacudGudTudCcagugsasc | 3529 | GUCACUGGAAACAGUGAGUCCGG | 2424 |
| AD-954277.1 | usgsuca(Ahd)cadGcdTacacacgugaL96 | 3350 | VPusdCsacdGudGuguadGcdTgdTugacasasg | 3530 | CUUGUCAACAGCUACACACGUGU | 2425 |
| AD-954285.1 | asasgcu(Ghd)agdCadTuaucagaggaL96 | 3351 | VPusdCscudCudGauaadTgdCudCagcuuscsc | 3531 | GGAAGCUGAGCAUUAUCAGAGGG | 2426 |
| AD-954293.1 | csgsgcu(Ghd)cudGadCuuguuuacgaL96 | 3352 | VPusdCsgudAadAcaagdTcdAgdCagccgsgsu | 3532 | ACCGGCUGCUGACUUGUUUACGA | 2427 |
| AD-954301.1 | cscsgcu(Ghd)acdAudTuccguuguaaL96 | 3353 | VPusdTsacdAadCggaadAudGudCagcggsgsu | 3533 | ACCCGCUGACAUUUCCGUUGUAC | 2428 |
| AD-954223.1 | asgscug(Ghd)uudCadGuuacgguuaL96 | 3354 | VPusdAsacdCcdGuaacdTgdAadCcagcusgsc | 3534 | GCAGCUGGUUCAGUUACGGGUUA | 2429 |
| AD-954231.1 | gsusgga(Ahd)gcdGadCugucucgacaL96 | 3355 | VPusdGsucdGadGacagdTcdGcdTuccacsusu | 3535 | AAGUGGAAGCGACUGUCUCGACA | 2430 |
| AD-954239.1 | ususuua(Chd)ggdAgdTauguucgucaL96 | 3356 | VPusdGsacdGadAcauadCudCcdGuaaaasgsc | 3536 | GCUUUUACGGAGUAUGUUCGUCA | 2431 |
| AD-954247.1 | asusuuu(Chd)aadGgdTuucuauuacaL96 | 3357 | VPusdGsuadAudAgaaadCcdTudGaaaausgsu | 3537 | ACAUUUUCAAGGUUUCUAUUACA | 943 |
| AD-954255.1 | csasaua(Ghd)agdAadAuaguacgaaaL96 | 3358 | VPusdTsucdGudAcuaudTudCudCuauugscsa | 3538 | UGCAAUAGAGAAAUAGUACGAAG | 2432 |
| AD-954263.1 | gsgscaa(Uhd)ucdAgdTcucguugugaL96 | 3359 | VPusdCsacdAadCgagadCudGadAuugccsusg | 3539 | CAGGCAAUUCAGUCUCGUUGUGA | 2433 |
| AD-954270.1 | asgscug(Ghd)ugdAadTcggauuccuaL96 | 3360 | VPusdAsggdAadTccgadTudCadCcagcuscsu | 3540 | AGAGCUGGUGAAUCGGAUUCCUG | 2434 |
| AD-954278.1 | gsuscaa(Chd)agdCudAcacacguguaL96 | 3361 | VPusdAscadCgdTgugudAgdCudGuugacsasa | 3541 | UUGUCAACAGCUACACACGUGUG | 2435 |
| AD-954286.1 | ususgag(Chd)ugdAudGuaugugacgaL96 | 3362 | VPusdCsgudCadCauacdAudCadGcucaasasc | 3542 | GUUUGAGCUGAUGUAUGUGACGC | 2436 |
| AD-954294.1 | gsgscug(Chd)ugdAcdTuguuuacgaaL96 | 3363 | VPusdTscgdTadAacaadGudCadGcagccsgsg | 3543 | CCGGCUGCUGACUUGUUUACGAA | 2437 |
| AD-954302.1 | gsascug(Uhd)cadTgdTggcuugguuaL96 | 3364 | VPusdAsacdCadAgccadCadTgdAcagucsgsc | 3544 | GCGACUGUCAUGUGGCUUGGUUU | 3556 |
| AD-954224.1 | gsusuca(Ghd)uudAcdGgguuaauuaaL96 | 3365 | VPusdTsaadTudAacccdGudAadCugaacscsa | 3545 | UGGUUCAGUUACGGGUUAAUUAC | 957 |
| AD-954232.1 | gsascug(Uhd)cudCgdAcagauagcuaL96 | 3366 | VPusdAsgcdTadTcugudCgdAgdAcagucsgsc | 3546 | GCGACUGUCUCGACAGAUAGCUG | 2438 |

TABLE 15-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-954240.1 | ususuac(Ghd)gadGudAuguucgucaaL96 | 3367 | VPusdTsgadCgdAacaudAcdTcdCguaaasasg | 3547 | CUUUUACGGAGUAUGUUCGUCAC | 2439 |
| AD-954248.1 | asasggu(Uhd)ucdTadTuacaacuggaL96 | 3368 | VPusdCscadGudTguaadTadGadAaccuusgsa | 3548 | UCAAGGUUUCUAUUACAACUGGU | 2440 |
| AD-954256.1 | gsascuc(Chd)gadGcdAcuuaacgugaL96 | 3369 | VPusdCsacdGudTaagudGcdTcdGgagucsasu | 3549 | AUGACUCCGAGCACUUAACGUGG | 2441 |
| AD-954271.1 | gscsugg(Uhd)gadAudCggauuccugaL96 | 3370 | VPusdCsagdGadAuccgdAudTcdAccagcsusc | 3550 | GAGCUGGUGAAUCGGAUUCCUGC | 2442 |
| AD-954279.1 | uscsaac(Ahd)gcdTadCacacgugugaL96 | 3371 | VPusdCsacdAcdGugugdTadGcdTguugascsa | 3551 | UGUCAACAGCUACACACGUGUGC | 2443 |
| AD-954287.1 | gsasgcu(Ghd)audGudAugugacgcuaL96 | 3372 | VPusdAsgcdGudCacaudAcdAudCagcucsasa | 3552 | UUGAGCUGAUGUAUGUGACGCUG | 2444 |
| AD-954295.1 | csusgcu(Ghd)acdTudGuuuacgaaaaL96 | 3373 | VPusdTsuudCgdTaaacdAadGudCagcagscsc | 3553 | GGCUGCUGACUUGUUUACGAAAU | 938 |

TABLE 17

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1019439.1 | cscsgcu(Chd)AfgGfUfUfcugcuuususasa | 3557 | VPusUfsaaaAfgCfAfgaacCfuGfagcggscsc | 3644 | GGCCGCUCAGGUUCUGCUUUUAC | 3731 |
| AD-1019442.1 | csuscag(Ghd)UfuCfUfGfcuuuuaccsusa | 3558 | VPusAfsgguAfaAfAfgcagAfaCfcugagscsg | 3645 | CGCUCAGGUUCUGCUUUUACCUG | 3732 |
| AD-1019438.1 | gscscgc(Uhd)CfaGfGfUfucugcuuususa | 3559 | VPusAfsaaaGfcAfGfaaccUfgAfgcggcscsg | 3646 | CGGCCGCUCAGGUUCUGCUUUUA | 3733 |
| AD-1019408.1 | asasagc(Uhd)GfaUfGfAfaggccuucgaL96 | 3560 | VPusCfsgaag(G2p)ccuucaUfcAfgcuuususc | 3647 | GAAAAGCUGAUGAAGGCCUUCGA | 3734 |
| AD-1019426.1 | uscsccu(Chd)AfaGfUfCfcuuccagcaaL96 | 3561 | VPusUfsgcug(G2p)aaggacUfuGfagggascsu | 3648 | AGUCCCUCAAGUCCUUCCAGCAG | 3735 |
| AD-1019440.1 | csgscuc(Ahd)GfgUfUfCfugcuuuuascsa | 3562 | VPusGfsuaaAfaGfCfagaaCfcUfgagcgsgsc | 3649 | GCCGCUCAGGUUCUGCUUUUACC | 3736 |
| AD-1019410.1 | csusgau(Ghd)AfaGfGfCfcuucgagucaL96 | 3563 | VPusGfsacuc(G2p)aaggccUfuCfaucagcsu | 3650 | AGCUGAUGAAGGCCUUCGAGUCC | 3737 |
| AD-1019405.1 | ascsccu(Ghd)GfaAfAfAfgcugaugaaaL96 | 3564 | VPusUfsucau(C2p)agcuuuUfcCfaggguscsg | 3651 | CGACCCUGGAAAAGCUGAUGAAG | 3738 |
| AD-1019422.1 | csgsagu(Chd)CfcUfCfAfaguccuuccaL96 | 3565 | VPusGfsgaag(G2p)acuugaGfgGfacucgsasa | 3652 | UUCGAGUCCCUCAAGUCCUUCCA | 3739 |
| AD-1019407.1 | usgsgaa(Ahd)AfgCfUfGfaugaaggccaL96 | 3566 | VPusGfsgccu(Tgn)caucagCfuUfuuccasgsg | 3653 | CCUGGAAAAGCUGAUGAAGGCCU | 3740 |
| AD-1019418.1 | cscsuuc(Ghd)AfgUfCfCfcucaaguccaL96 | 3567 | VPusGfsgacu(Tgn)gagggaCfuCfgaaggscsc | 3654 | GGCCUUCGAGUCCCUCAAGUCCU | 3741 |
| AD-1019436.1 | ascsggc(Chd)GfcUfCfAfgguucugcsusa | 3568 | VPusAfsgcaGfaAfCfcugaGfcGfgccguscsc | 3655 | GGACGGCCGCUCAGGUUCUGCUU | 3742 |
| AD-1019406.1 | csusgga(Ahd)AfaGfCfUfgaugaaggcaL96 | 3569 | VPusGfsccuu(C2p)aucagcUfuUfuccagsgsg | 3656 | CCCUGGAAAAGCUGAUGAAGGCC | 3743 |
| AD-1019417.1 | gscscuu(Chd)GfaGfUfCfccucaagucaL96 | 3570 | VPusGfsacuu(G2p)agggacUfcGfaaggcscsu | 3657 | AGGCCUUCGAGUCCCUCAAGUCC | 3744 |

TABLE 17-continued

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| Modified Sense and Antisense Strand Sequences of Huntingtin (HTT) dsRNA Agents | | | | | | |
| AD-1019372.1 | gscscgc(Uhd)CfaGfGfUfucugcuuuuaL96 | 3571 | VPusAfsaaag(C2p)agaaccUfgAfgcggcscsg | 3658 | CGGCCGCUCAGGUUCUGCUUUUA | 3733 |
| AD-1019375.1 | gscsuca(Ghd)GfuUfCfUfgcuuuuaccaL96 | 3572 | VPusGfsguaa(Agn)agcagaAfcCfugagcsgsg | 3659 | CCGCUCAGGUUCUGCUUUUACCU | 3745 |
| AD-1019444.1 | csasggu(Uhd)CfuGfCfUfuuuaccugscsa | 3573 | VPusGfscagGfuAfAfaagcAfgAfaccugsasg | 3660 | CUCAGGUUCUGCUUUUACCUGCG | 3746 |
| AD-1019448.1 | cscsaga(Ghd)CfcCfCfAfuucauugcscsa | 3574 | VPusGfsgcaAfuGfAfauggGfgCfucuggsgsc | 3661 | GCCCAGAGCCCCAUUCAUUGCCC | 3747 |
| AD-1019365.1 | uscscaa(Ghd)AfuGfGfAfcggccgcucaL96 | 3575 | VPusGfsagcg(G2p)ccguccAfuCfuuggascsc | 3662 | GGUCCAAGAUGGACGGCCGCUCA | 3748 |
| AD-1019374.1 | csgscuc(Ahd)GfgUfUfCfugcuuuuacaL96 | 3576 | VPusGfsuaaa(Agn)gcagaaCfcUfgagcgsgsc | 3663 | GCCGCUCAGGUUCUGCUUUUACC | 3736 |
| AD-1019402.1 | gscsgac(Chd)CfuGfGfAfaaagcugauaL96 | 3577 | VPusAfsucag(C2p)uuuuccAfgGfgucgcscsa | 3664 | UGGCGACCCUGGAAAAGCUGAUG | 3749 |
| AD-1019441.1 | gscsuca(Ghd)GfuUfCfUfgcuuuuacscsa | 3578 | VPusGfsguaAfaAfGfcagaAfcCfugagcsgsg | 3665 | CCGCUCAGGUUCUGCUUUUACCU | 3745 |
| AD-1019399.1 | cscsaug(Ghd)CfgAfCfCfcuggaaaagaL96 | 3579 | VPusCfsuuuu(C2p)cagggucfgCfcauggcscsg | 3666 | CGCCAUGGCGACCCUGGAAAAGC | 3750 |
| AD-1019378.1 | csasggu(Uhd)CfuGfCfUfuuuaccugcaL96 | 3580 | VPusGfscagg(Tgn)aaaagcAfgAfaccugsasg | 3667 | CUCAGGUUCUGCUUUUACCUGCG | 3746 |
| AD-1019419.1 | csuscg(Ahd)GfuCfCfCfucaaguccuaL96 | 3581 | VPusAfsggac(Tgn)ugagggAfcUfcgaagsgsc | 3668 | GCCUUCGAGUCCCUCAAGUCCUU | 3751 |
| AD-1019423.1 | gsasguc(Chd)CfuCfAfAfguccuuccaaL96 | 3582 | VPusUfsggaa(G2p)gacuugAfgGfgacucgsgsa | 3669 | UCGAGUCCCUCAAGUCCUUCCAG | 3752 |
| AD-1019437.1 | csgsgcc(Ghd)CfuCfAfGfguucugcususa | 3583 | VPusAfsagcAfgAfAfccugAfgCfggccgsusc | 3670 | GACGGCCGCUCAGGUUCUGCUUU | 3753 |
| AD-1019376.1 | csuscag(Ghd)UfuCfUfGfcuuuuaccuaL96 | 3584 | VPusAfsggua(Agn)aagcagAfaCfcugagscsg | 3671 | CGCUCAGGUUCUGCUUUUACCUG | 3732 |
| AD-1019373.1 | cscsgcu(Chd)AfgGfUfUfcugcuuuuaaL96 | 3585 | VPusUfsaaaa(G2p)cagaacCfuGfagcggcscsc | 3672 | GGCCGCUCAGGUUCUGCUUUUAC | 3731 |
| AD-1019435.1 | gsgsacg(Ghd)CfcGfCfUfcaggguucusgsa | 3586 | VPusCfsagaAfcCfUfgagcGfgCfcguccsasu | 3673 | AUGGACGGCCGCUCAGGUUCUGC | 3754 |
| AD-1019411.1 | usgsaug(Ahd)AfgGfCfCfuucgaguccaL96 | 3587 | VPusGfsgacu(C2p)gaaggcCfuUfcaucasgsc | 3674 | GCUGAUGAAGGCCUUCGAGUCCC | 3755 |
| AD-1019434.1 | usgsgac(Ghd)GfcCfGfCfucagguucsusa | 3588 | VPusAfsgaaCfcUfGfagcgGfcCfguccasusc | 3675 | GAUGGACGGCCGCUCAGGUUCUG | 3756 |
| AD-1019377.1 | uscsagg(Uhd)UfcUfGfCfuuuuaccugaL96 | 3589 | VPusCfsaggu(Agn)aaagcaGfaAfccugasgsc | 3676 | GCUCAGGUUCUGCUUUUACCUGC | 3757 |
| AD-1019412.1 | gsasuga(Ahd)GfgCfCfUfucgagucccaL96 | 3590 | VPusGfsggac(Tgn)cgaaggCfcUfucaucsasg | 3677 | CUGAUGAAGGCCUUCGAGUCCCU | 3758 |
| AD-1019403.1 | csgsacc(Chd)UfgGfAfAfaagcugaugaL96 | 3591 | VPusCfsauca(G2p)cuuuucCfaGfggucgcscsc | 3678 | GGCGACCCUGGAAAAGCUGAUGA | 3759 |
| AD-1019368.1 | usgsgac(Ghd)GfcCfGfCfucagguucuaL96 | 3592 | VPusAfsgaac(C2p)ugagcgGfcCfguccasusc | 3679 | GAUGGACGGCCGCUCAGGUUCUG | 3756 |
| AD-1019404.1 | gsasccc(Uhd)GfgAfAfAfagcugaugaaL96 | 3593 | VPusUfscauc(Agn)gcuuuuCfcAfgggucsgsc | 3680 | GCGACCCUGGAAAAGCUGAUGAA | 3760 |
| AD-1019415.1 | asasggc(Chd)UfuCfGfAfguccccucaaaL96 | 3594 | VPusUfsugag(G2p)gacucgAfaGfgccuuscsa | 3681 | UGAAGGCCUUCGAGUCCCUCAAG | 3761 |

TABLE 17-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1019421.1 | uscsgag(Uhd)CfcCfUfCfaaguccuucaL96 | 3595 | VPusGfsaagg(Agn)cuugagGfgAfcucgasasg | 3682 | CUUCGAGUCCCUCAAGUCCUUCC | 3762 |
| AD-1019400.1 | asusggc(Ghd)AfcCfCfUfggaaaagcuaL96 | 3596 | VPusAfsgcuu(Tgn)uccaggGfuCfgccausgsg | 3683 | CCAUGGCGACCCUGGAAAAGCUG | 3763 |
| AD-1019450.1 | cscsauu(Chd)AfuUfGfCfcccggugcsusa | 3597 | VPusAfsgcaCfcGfGfggcaAfuGfaauggsgsg | 3684 | CCCCAUUCAUUGCCCCGGUGCUG | 3764 |
| AD-1019420.1 | ususcga(Ghd)UfcCfCfUfcaaguccuuaL96 | 3598 | VPusAfsagga(C2p)uugaggGfaCfucgaasgsg | 3685 | CCUUCGAGUCCCUCAAGUCCUUC | 3765 |
| AD-1019429.1 | gsascgg(Ghd)UfcCfAfAfgauggacgsgsa | 3599 | VPusCfscguCfcAfUfcuugGfaCfccgucscsc | 3686 | GGGACGGGUCCAAGAUGGACGGC | 3766 |
| AD-1019431.1 | uscscaa(Ghd)AfuGfGfAfcggccgcuscsa | 3600 | VPusGfsagcGfgCfCfguccAfuCfuuggascsc | 3687 | GGUCCAAGAUGGACGGCCGCUCA | 3748 |
| AD-1019428.1 | gsgsacg(Ghd)GfuCfCfAfagauggacgsgsa | 3601 | VPusCfsgucCfaUfCfuuggAfcCfcguccscsg | 3688 | CGGGACGGGUCCAAGAUGGACGG | 3767 |
| AD-1019364.1 | ascsggg(Uhd)CfcAfAfGfauggacggcaL96 | 3602 | VPusGfsccgu(C2p)caucuuGfgAfcccguscsc | 3689 | GGACGGGUCCAAGAUGGACGGCC | 3768 |
| AD-1019413.1 | asusgaa(Ghd)GfcCfUfUfcgagucccuaL96 | 3603 | VPusAfsggga(C2p)ucgaagGfcCfuucauscsa | 3690 | UGAUGAAGGCCUUCGAGUCCCUC | 3769 |
| AD-1019394.1 | cscsucc(Ghd)GfgGfAfCfugccgugccaL96 | 3604 | VPusGfsgcac(G2p)gcagucCfcCfggaggscsc | 3691 | GGCCUCCGGGGACUGCCGUGCCG | 3770 |
| AD-1019398.1 | gscscau(Ghd)GfcGfAfCfccuggaaaaaL96 | 3605 | VPusUfsuuuc(C2p)agggucGfcCfauggcsgsg | 3692 | CCGCCAUGGCGACCCUGGAAAAG | 3771 |
| AD-1019366.1 | asasgau(Ghd)GfaCfGfGfccgcucaggaL96 | 3606 | VPusCfscuga(G2p)cggccgUfcCfaucuusgsg | 3693 | CCAAGAUGGACGGCCGCUCAGGU | 3772 |
| AD-1019432.1 | asasgau(Ghd)GfaCfGfGfccgcucagsgsa | 3607 | VPusCfscugAfgCfGfgccgUfcCfaucuusgsg | 3694 | CCAAGAUGGACGGCCGCUCAGGU | 3772 |
| AD-1019380.1 | ususcug(Chd)UfuUfUfAfccugcggccaL96 | 3608 | VPusGfsgccg(C2p)agguaaAfaGfcagaascsc | 3695 | GGUUCUGCUUUUACCUGCGGCCC | 3773 |
| AD-1019382.1 | cscsaga(Ghd)CfcCfCfAfuucauugccaL96 | 3609 | VPusGfsgcaa(Tgn)gaauggGfgCfucuggsgsc | 3696 | GCCCAGAGCCCCAUUCAUUGCCC | 3747 |
| AD-1019433.1 | asgsaug(Ghd)AfcGfGfCfcgcucaggsusa | 3610 | VPusAfsccuGfaGfCfggccGfuCfcaucusug | 3697 | CAAGAUGGACGGCCGCUCAGGUU | 3774 |
| AD-1019424.1 | asgsucc(Chd)UfcAfAfGfuccuuccagaL96 | 3611 | VPusCfsugga(Agn)ggacuuGfaGfggacuscsg | 3698 | CGAGUCCCUCAAGUCCUUCCAGC | 3775 |
| AD-1019445.1 | gsgsuuc(Uhd)GfcUfUfUfuaccugcgsgsa | 3612 | VPusCfscgcAfgGfUfaaaaGfcAfgaaccsusg | 3699 | CAGGUUCUGCUUUUACCUGCGGC | 3776 |
| AD-1019369.1 | gsgsacg(Ghd)CfcGfCfUfcagguucugaL96 | 3613 | VPusCfsagaa(C2p)cugagcGfgCfcguccsasu | 3700 | AUGGACGGCCGCUCAGGUUCUGC | 3754 |
| AD-1019416.1 | gsgsccu(Uhd)CfgAfGfUfcccucaaguaL96 | 3614 | VPusAfscuug(Agn)gggacuCfgAfaggccsusu | 3701 | AAGGCCUUCGAGUCCCUCAAGUC | 3777 |
| AD-1019414.1 | usgsaag(Ghd)CfcUfUfCfgagucccucaL96 | 3615 | VPusGfsaggg(Agn)cucgaaGfgCfcuucasusc | 3702 | GAUGAAGGCCUUCGAGUCCCUCA | 3778 |
| AD-1019447.1 | cscscag(Ahd)GfcCfCfCfauucauugscsa | 3616 | VPusGfscaaUfgAfAfugggGfcUfcugggscsc | 3703 | GGCCCAGAGCCCCAUUCAUUGCC | 3779 |
| AD-1019430.1 | ascsggg(Uhd)CfcAfAfGfauggacggscsa | 3617 | VPusGfsccgUfcCfAfucuuGfgAfcccguscsc | 3704 | GGACGGGUCCAAGAUGGACGGCC | 3768 |
| AD-1019395.1 | csusccg(Ghd)GfgAfCfUfgccgugccgaL96 | 3618 | VPusCfsggca(C2p)ggcaguCfcCfcggagsgsc | 3705 | GCCUCCGGGGACUGCCGUGCCGG | 3780 |
| AD-1019396.1 | cscsgug(Chd)CfgGfGfCfgggagaccgaL96 | 3619 | VPusCfsgguc(Tgn)cccgccCfgGfcacggscsa | 3706 | UGCCGUGCCGGGCGGGAGACCGC | 3781 |

TABLE 17-continued

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| Modified Sense and Antisense Strand Sequences of Huntingtin (HTT) dsRNA Agents | | | | | | |
| AD-1019425.1 | gsusccc(Uhd)CfaAfGfUfccuuccagcaL96 | 3620 | VPusGfscugg(Agn)aggacuUfgAfgggacsusc | 3707 | GAGUCCCUCAAGUCCUUCCAGCA | 3782 |
| AD-1019363.1 | gsascgg(Ghd)UfcCfAfAfgauggacggaL96 | 3621 | VPusCfscguc(C2p)aucuugGfaCfccgucscsc | 3708 | GGGACGGGUCCAAGAUGGACGGC | 3766 |
| AD-1019367.1 | asgsaug(Ghd)AfcGfGfCfcgcucagguaL96 | 3622 | VPusAfsccug(Agn)gcggccGfuCfcaucusug | 3709 | CAAGAUGGACGGCCGCUCAGGUU | 3774 |
| AD-1019362.1 | gsgsacg(Ghd)GfuCfCfAfagauggacgaL96 | 3623 | VPusCfsgucc(Agn)ucuuggAfcCfcguccscsg | 3710 | CGGGACGGGUCCAAGAUGGACGG | 3767 |
| AD-1019379.1 | gsgsuuc(Uhd)GfcUfUfUfuaccugcggaL96 | 3624 | VPusCfscgca(G2p)guaaaaGfcAfgaaccsusg | 3711 | CAGGUUCUGCUUUUACCUGCGGC | 3776 |
| AD-1019397.1 | ascscgc(Chd)AfuGfGfCfgacccuggaaL96 | 3625 | VPusUfsccag(G2p)gucgccAfuGfgcgguscsu | 3712 | AGACCGCCAUGGCGACCCUGGAA | 3783 |
| AD-1019392.1 | csgsagg(Chd)CfuCfCfGfgggacugccaL96 | 3626 | VPusGfsgcag(Tgn)ccccggAfgGfccucgsgsg | 3713 | CCCGAGGCCUCCGGGGACUGCCG | 3784 |
| AD-1019409.1 | asasgcu(Ghd)AfuGfAfAfggccuucgaaL96 | 3627 | VPusUfscgaa(G2p)gccuucAfuCfagcuususu | 3714 | AAAAGCUGAUGAAGGCCUUCGAG | 3785 |
| AD-1019361.1 | csgsgga(Chd)GfgGfUfCfcaagauggaaL96 | 3628 | VPusUfsccau(C2p)uuggacCfcGfucccgsgsc | 3715 | GCCGGGACGGGUCCAAGAUGGAC | 3786 |
| AD-1019449.1 | csasgag(Chd)CfcCfAfUfucauugccscsa | 3629 | VPusGfsggcAfaUfGfaaugGfgGfcucugsgsg | 3716 | CCCAGAGCCCCAUUCAUUGCCCC | 3787 |
| AD-1019385.1 | usgscug(Ahd)GfcGfGfCfgccgcgaguaL96 | 3630 | VPusAfscucg(C2p)ggcgccGfcUfcagcascsc | 3717 | GGUGCUGAGCGGCGCCGCGAGUC | 3788 |
| AD-1019427.1 | csgsgga(Chd)GfgGfUfCfcaagauggsasa | 3631 | VPusUfsccaUfcUfUfggacCfcGfucccgsgsc | 3718 | GCCGGGACGGGUCCAAGAUGGAC | 3786 |
| AD-1019390.1 | cscscga(Ghd)GfcCfUfCfcggggacugaL96 | 3632 | VPusCfsaguc(C2p)ccggagGfcCfucgggscsc | 3719 | GGCCCGAGGCCUCCGGGGACUGC | 3789 |
| AD-1019383.1 | csasgag(Chd)CfcCfAfUfucauugcccaL96 | 3633 | VPusGfsggca(Agn)ugaaugGfgGfcucugsgsg | 3720 | CCCAGAGCCCCAUUCAUUGCCCC | 3787 |
| AD-1019401.1 | usgsgcg(Ahd)CfcCfUfGfgaaaagcugaL96 | 3634 | VPusCfsagcu(Tgn)uuccagGfgUfcgccasusg | 3721 | CAUGGCGACCCUGGAAAAGCUGA | 3790 |
| AD-1019393.1 | gsasggc(Chd)UfcCfGfGfggacugccgaL96 | 3635 | VPusCfsggca(G2p)uccccgGfaGfgccucsgsg | 3722 | CCGAGGCCUCCGGGGACUGCCGU | 3791 |
| AD-1019370.1 | ascsggc(Chd)GfcUfCfAfgguucugcuaL96 | 3636 | VPusAfsgcag(Agn)accugaGfcGfgccguscsc | 3723 | GGACGGCCGCUCAGGUUCUGCUU | 3742 |
| AD-1019391.1 | cscsgag(Ghd)CfcUfCfCfggggacugcaL96 | 3637 | VPusGfscagu(C2p)cccggaGfgCfcucggsgsc | 3724 | GCCCGAGGCCUCCGGGGACUGCC | 3792 |
| AD-1019446.1 | ususcug(Chd)UfuUfUfAfccugcggcscsa | 3638 | VPusGfsgccGfcAfGfguaaAfaGfcagaascsc | 3725 | GGUUCUGCUUUUACCUGCGGCCC | 3773 |
| AD-1019371.1 | csgsgcc(Ghd)CfuCfAfGfguucugcuuaL96 | 3639 | VPusAfsagca(G2p)aaccugAfgCfggccgsusc | 3726 | GACGGCCGCUCAGGUUCUGCUUU | 3753 |
| AD-1019386.1 | gscsuga(Ghd)CfgGfCfGfccgcgagucaL96 | 3640 | VPusGfsacuc(G2p)cggcgcCfgCfucagcsasc | 3727 | GUGCUGAGCGGCGCCGCGAGUCG | 3793 |
| AD-1019389.1 | gscsccg(Ahd)GfgCfCfUfccggggacuaL96 | 3641 | VPusAfsgucc(C2p)cggaggCfcUfcgggcscsg | 3728 | CGGCCCGAGGCCUCCGGGGACUG | 3794 |
| AD-1019387.1 | gsasguc(Ghd)GfcCfCfGfaggccuccgaL96 | 3642 | VPusCfsggag(G2p)ccucggGfcCfgacucsgsc | 3729 | GCGAGUCGGCCCGAGGCCUCCGG | 3795 |
| AD-1019381.1 | cscscag(Ahd)GfcCfCfCfauucauugcaL96 | 3643 | VPusGfscaau(G2p)aaugggGfcUfcugggscsc | 3730 | GGCCCAGAGCCCCAUUCAUUGCC | 3779 |

TABLE 18

| Unmodified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Range in NM_002111.8 | Antisense Sequence 5' to 3' | SEQ ID NO: | Range in NM_002111.8 |
| AD-1019439.1 | CCGCUCAGGUUCUGCUUUUAA | 3796 | 29-49 | UUAAAAGCAGAACCUGAGCGGCC | 3861 | 27-49 |
| AD-1019442.1 | CUCAGGUUCUGCUUUUACCUA | 3797 | 32-52 | UAGGUAAAAGCAGAACCUGAGCG | 3862 | 30-52 |
| AD-1019438.1 | GCCGCUCAGGUUCUGCUUUUA | 3798 | 28-48 | UAAAAGCAGAACCUGAGCGGCCG | 3863 | 26-48 |
| AD-1019408.1 | AAAGCUGAUGAAGGCCUUCGA | 3799 | 160-180 | UCGAAGGCCUUCAUCAGCUUUUC | 3864 | 158-180 |
| AD-1019426.1 | UCCCUCAAGUCCUUCCAGCAA | 3800 | 182-202 | UUGCUGGAAGGACUUGAGGGACU | 3865 | 180-202 |
| AD-1019440.1 | CGCUCAGGUUCUGCUUUUACA | 3801 | 30-50 | UGUAAAAGCAGAACCUGAGCGGC | 3866 | 28-50 |
| AD-1019410.1 | CUGAUGAAGGCCUUCGAGUCA | 3802 | 164-184 | UGACUCGAAGGCCUUCAUCAGCU | 3867 | 162-184 |
| AD-1019405.1 | ACCCUGGAAAAGCUGAUGAAA | 3803 | 152-172 | UUUCAUCAGCUUUUCCAGGGUCG | 3868 | 150-172 |
| AD-1019422.1 | CGAGUCCCUCAAGUCCUUCCA | 3804 | 178-198 | UGGAAGGACUUGAGGGACUCGAA | 3869 | 176-198 |
| AD-1019407.1 | UGGAAAAGCUGAUGAAGGCCA | 3805 | 156-176 | UGGCCUTCAUCAGCUUUUCCAGG | 3870 | 154-176 |
| AD-1019418.1 | CCUUCGAGUCCCUCAAGUCCA | 3806 | 174-194 | UGGACUTGAGGGACUCGAAGGCC | 3871 | 172-194 |
| AD-1019436.1 | ACGGCCGCUCAGGUUCUGCUA | 3807 | 25-45 | UAGCAGAACCUGAGCGGCCGUCC | 3872 | 23-45 |
| AD-1019406.1 | CUGGAAAAGCUGAUGAAGGCA | 3808 | 155-175 | UGCCUUCAUCAGCUUUUCCAGGG | 3873 | 153-175 |
| AD-1019417.1 | GCCUUCGAGUCCCUCAAGUCA | 3809 | 173-193 | UGACUUGAGGGACUCGAAGGCCU | 3874 | 171-193 |
| AD-1019372.1 | GCCGCUCAGGUUCUGCUUUUA | 3798 | 28-48 | UAAAAGCAGAACCUGAGCGGCCG | 3863 | 26-48 |
| AD-1019375.1 | GCUCAGGUUCUGCUUUUACCA | 3810 | 31-51 | UGGUAAAAGCAGAACCUGAGCGG | 3875 | 29-51 |
| AD-1019444.1 | CAGGUUCUGCUUUUACCUGCA | 3811 | 34-54 | UGCAGGUAAAAGCAGAACCUGAG | 3876 | 32-54 |
| AD-1019448.1 | CCAGAGCCCCAUUCAUUGCCA | 3812 | 57-77 | UGGCAAUGAAUGGGGCUCUGGGC | 3877 | 55-77 |
| AD-1019365.1 | UCCAAGAUGGACGGCCGCUCA | 3813 | 15-35 | UGAGCGGCCGUCCAUCUUGGACC | 3878 | 13-35 |
| AD-1019374.1 | CGCUCAGGUUCUGCUUUUACA | 3801 | 30-50 | UGUAAAAGCAGAACCUGAGCGGC | 3866 | 28-50 |
| AD-1019402.1 | GCGACCCUGGAAAAGCUGAUA | 3814 | 149-169 | UAUCAGCUUUUCCAGGGUCGCCA | 3879 | 147-169 |
| AD-1019441.1 | GCUCAGGUUCUGCUUUUACCA | 3810 | 31-51 | UGGUAAAAGCAGAACCUGAGCGG | 3875 | 29-51 |
| AD-1019399.1 | CCAUGGCGACCCUGGAAAAGA | 3815 | 144-164 | UCUUUUCCAGGGUCGCCAUGGCG | 3880 | 142-164 |
| AD-1019378.1 | CAGGUUCUGCUUUUACCUGCA | 3811 | 34-54 | UGCAGGTAAAAGCAGAACCUGAG | 3881 | 32-54 |
| AD-1019419.1 | CUUCGAGUCCCUCAAGUCCUA | 3816 | 175-195 | UAGGACTUGAGGGACUCGAAGGC | 3882 | 173-195 |
| AD-1019423.1 | GAGUCCCUCAAGUCCUUCCAA | 3817 | 179-199 | UUGGAAGGACUUGAGGGACUCGA | 3883 | 177-199 |
| AD-1019437.1 | CGGCCGCUCAGGUUCUGCUUA | 3818 | 26-46 | UAAGCAGAACCUGAGCGGCCGUC | 3884 | 24-46 |
| AD-1019376.1 | CUCAGGUUCUGCUUUUACCUA | 3797 | 32-52 | UAGGUAAAAGCAGAACCUGAGCG | 3862 | 30-52 |
| AD-1019373.1 | CCGCUCAGGUUCUGCUUUUAA | 3796 | 29-49 | UUAAAAGCAGAACCUGAGCGGCC | 3861 | 27-49 |
| AD-1019435.1 | GGACGGCCGCUCAGGUUCUGA | 3819 | 23-43 | UCAGAACCUGAGCGGCCGUCCAU | 3885 | 21-43 |
| AD-1019411.1 | UGAUGAAGGCCUUCGAGUCCA | 3820 | 165-185 | UGGACUCGAAGGCCUUCAUCAGC | 3886 | 163-185 |
| AD-1019434.1 | UGGACGGCCGCUCAGGUUCUA | 3821 | 22-42 | UAGAACCUGAGCGGCCGUCCAUC | 3887 | 20-42 |
| AD-1019377.1 | UCAGGUUCUGCUUUUACCUGA | 3822 | 33-53 | UCAGGUAAAAGCAGAACCUGAGC | 3888 | 31-53 |
| AD-1019412.1 | GAUGAAGGCCUUCGAGUCCCA | 3823 | 166-186 | UGGGACTCGAAGGCCUUCAUCAG | 3889 | 164-186 |
| AD-1019403.1 | CGACCCUGGAAAAGCUGAUGA | 3824 | 150-170 | UCAUCAGCUUUUCCAGGGUCGCC | 3890 | 148-170 |
| AD-1019368.1 | UGGACGGCCGCUCAGGUUCUA | 3821 | 22-42 | UAGAACCUGAGCGGCCGUCCAUC | 3887 | 20-42 |
| AD-1019404.1 | GACCCUGGAAAAGCUGAUGAA | 3825 | 151-171 | UUCAUCAGCUUUUCCAGGGUCGC | 3891 | 149-171 |

TABLE 18-continued

| Unmodified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Range in NM_002111.8 | Antisense Sequence 5' to 3' | SEQ ID NO: | Range in NM_002111.8 |
| AD-1019415.1 | AAGGCCUUCGAGUCCCUCAAA | 3826 | 170-190 | UUUGAGGGACUCGAAGGCCUUCA | 3892 | 168-190 |
| AD-1019421.1 | UCGAGUCCCUCAAGUCCUUCA | 3827 | 177-197 | UGAAGGACUUGAGGGACUCGAAG | 3893 | 175-197 |
| AD-1019400.1 | AUGGCGACCCUGGAAAAGCUA | 3828 | 146-166 | UAGCUUUUCCAGGGUCGCCAUGG | 3894 | 144-166 |
| AD-1019450.1 | CCAUUCAUUGCCCCGGUGCUA | 3829 | 65-85 | UAGCACCGGGGCAAUGAAUGGGG | 3895 | 63-85 |
| AD-1019420.1 | UUCGAGUCCCUCAAGUCCUUA | 3830 | 176-196 | UAAGGACUUGAGGGACUCGAAGG | 3896 | 174-196 |
| AD-1019429.1 | GACGGGUCCAAGAUGGACGGA | 3831 | 9-29 | UCCGUCCAUCUUGGACCCGUCCC | 3897 | 7-29 |
| AD-1019431.1 | UCCAAGAUGGACGGCCGCUCA | 3813 | 15-35 | UGAGCGGCCGUCCAUCUUGGACC | 3878 | 13-35 |
| AD-1019428.1 | GGACGGGUCCAAGAUGGACGA | 3832 | 8-29 | UCGUCCAUCUUGGACCCGUCCCG | 3898 | 6-29 |
| AD-1019364.1 | ACGGGUCCAAGAUGGACGGCA | 3833 | 10-30 | UGCCGUCCAUCUUGGACCCGUCC | 3899 | 10-30 |
| AD-1019413.1 | AUGAAGGCCUUCGAGUCCCUA | 3834 | 167-187 | UAGGGACUCGAAGGCCUUCAUCA | 3900 | 165-187 |
| AD-1019394.1 | CCUCCGGGGACUGCCGUGCCA | 3835 | 111-131 | UGGCACGGCAGUCCCCGGAGGCC | 3901 | 109-131 |
| AD-1019398.1 | GCCAUGGCGACCCUGGAAAAA | 3836 | 143-163 | UUUUUCCAGGGUCGCCAUGGCGG | 3902 | 141-163 |
| AD-1019366.1 | AAGAUGGACGGCCGCUCAGGA | 3837 | 18-38 | UCCUGAGCGGCCGUCCAUCUUGG | 3903 | 16-38 |
| AD-1019432.1 | AAGAUGGACGGCCGCUCAGGA | 3837 | 18-38 | UCCUGAGCGGCCGUCCAUCUUGG | 3903 | 16-38 |
| AD-1019380.1 | UUCUGCUUUUACCUGCGGCCA | 3838 | 38-58 | UGGCCGCAGGUAAAAGCAGAACC | 3904 | 36-58 |
| AD-1019382.1 | CCAGAGCCCCAUUCAUUGCCA | 3812 | 57-77 | UGGCAAUGAAUGGGGCUCUGGGC | 3905 | 55-77 |
| AD-1019433.1 | AGAUGGACGGCCGCUCAGGUA | 3839 | 19-39 | UACCUGAGCGGCCGUCCAUCUUG | 3906 | 17-39 |
| AD-1019424.1 | AGUCCCUCAAGUCCUUCCAGA | 3840 | 180-200 | UCUGGAAGGACUUGAGGGACUCG | 3907 | 178-200 |
| AD-1019445.1 | GGUUCUGCUUUUACCUGCGGA | 3841 | 36-56 | UCCGCAGGUAAAAGCAGAACCUG | 3908 | 34-56 |
| AD-1019369.1 | GGACGGCCGCUCAGGUUCUGA | 3819 | 23-43 | UCAGAACCUGAGCGGCCGUCCAU | 3885 | 21-43 |
| AD-1019416.1 | GGCCUUCGAGUCCCUCAAGUA | 3842 | 172-192 | UACUUGAGGGACUCGAAGGCCUU | 3909 | 170-192 |
| AD-1019414.1 | UGAAGGCCUUCGAGUCCCUCA | 3843 | 168-188 | UGAGGGACUCGAAGGCCUUCAUC | 3910 | 166-188 |
| AD-1019447.1 | CCCAGAGCCCCAUUCAUUGCA | 3844 | 56-76 | UGCAAUGAAUGGGGCUCUGGGCC | 3911 | 54-76 |
| AD-1019430.1 | ACGGGUCCAAGAUGGACGGCA | 3833 | 10-30 | UGCCGUCCAUCUUGGACCCGUCC | 3899 | 10-30 |
| AD-1019395.1 | CUCCGGGGACUGCCGUGCCGA | 3845 | 112-132 | UCGGCACGGCAGUCCCCGGAGGC | 3912 | 110-132 |
| AD-1019396.1 | CCGUGCCGGGCGGGAGACCGA | 3846 | 124-144 | UCGGUCTCCCGCCCGGCACGGCA | 3913 | 122-144 |
| AD-1019425.1 | GUCCCUCAAGUCCUUCCAGCA | 3847 | 181-201 | UGCUGGAAGGACUUGAGGGACUC | 3914 | 179-201 |
| AD-1019363.1 | GACGGGUCCAAGAUGGACGGA | 3831 | 9-29 | UCCGUCCAUCUUGGACCCGUCCC | 3897 | 7-29 |
| AD-1019367.1 | AGAUGGACGGCCGCUCAGGUA | 3839 | 19-39 | UACCUGAGCGGCCGUCCAUCUUG | 3906 | 17-39 |
| AD-1019362.1 | GGACGGGUCCAAGAUGGACGA | 3832 | 8-28 | UCGUCCAUCUUGGACCCGUCCCG | 3898 | 6-28 |
| AD-1019379.1 | GGUUCUGCUUUUACCUGCGGA | 3841 | 36-56 | UCCGCAGGUAAAAGCAGAACCUG | 3908 | 34-56 |
| AD-1019397.1 | ACCGCCAUGGCGACCCUGGAA | 3848 | 140-160 | UUCCAGGGUCGCCAUGGCGGUCU | 3915 | 138-160 |
| AD-1019392.1 | CGAGGCCUCCGGGGACUGCCA | 3849 | 106-126 | UGGCAGTCCCCGGAGGCCUCGGG | 3916 | 104-126 |
| AD-1019409.1 | AAGCUGAUGAAGGCCUUCGAA | 3850 | 161-181 | UUCGAAGGCCUUCAUCAGCUUUU | 3917 | 159-181 |
| AD-1019361.1 | CGGGACGGGUCCAAGAUGGAA | 3851 | 6-26 | UUCCAUCUUGGACCCGUCCCGGC | 3918 | 4-26 |
| AD-1019449.1 | CAGAGCCCCAUUCAUUGCCCA | 3852 | 58-78 | UGGGCAAUGAAUGGGGCUCUGGG | 3919 | 56-78 |
| AD-1019385.1 | UGCUGAGCGGCGCCGCGAGUA | 3853 | 81-101 | UACUCGCGGCGCCGCUCAGCACC | 3920 | 79-101 |

TABLE 18-continued

Unmodified Sense and Antisense Strand Sequences of Huntingtin (HTT) dsRNA Agents

| Duplex ID | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-1019427.1 | CGGGACGGGUCCAAGAUGGAA | 3851 | 6-26 | UUCCAUCUUGGACCCGUCCCGGC | 3918 | 4-26 |
| AD-1019390.1 | CCCGAGGCCUCCGGGGACUGA | 3854 | 104-124 | UCAGUCCCCGGAGGCCUCGGGCC | 3921 | 102-124 |
| AD-1019383.1 | CAGAGCCCCAUUCAUUGCCCA | 3852 | 58-78 | UGGGCAAUGAAUGGGGCUCUGGG | 3919 | 56-78 |
| AD-1019401.1 | UGGCGACCCUGGAAAAGCUGA | 3855 | 147-167 | UCAGCUUUCCAGGGUCGCCAUG | 3922 | 145-167 |
| AD-1019393.1 | GAGGCCUCCGGGGACUGCCGA | 3856 | 107-127 | UCGGCAGUCCCCGGAGGCCUCGG | 3923 | 105-127 |
| AD-1019370.1 | ACGGCCGCUCAGGUUCUGCUA | 3807 | 25-45 | UAGCAGAACCUGAGCGGCCGUCC | 3872 | 23-45 |
| AD-1019391.1 | CCGAGGCCUCCGGGGACUGCA | 3857 | 105-125 | UGCAGUCCCCGGAGGCCUCGGGC | 3924 | 103-125 |
| AD-1019446.1 | UUCUGCUUUUACCUGCGGCCA | 3838 | 38-58 | UGGCCGCAGGUAAAAGCAGAACC | 3904 | 36-58 |
| AD-1019371.1 | CGGCCGCUCAGGUUCUGCUUA | 3818 | 26-46 | UAAGCAGAACCUGAGCGGCCGUC | 3884 | 24-46 |
| AD-1019386.1 | GCUGAGCGGCGCCGCGAGUCA | 3858 | 82-102 | UGACUCGCGGCGCCGCUCAGCAC | 3925 | 80-102 |
| AD-1019389.1 | GCCCGAGGCCUCCGGGGACUA | 3859 | 103-123 | UAGUCCCCGGAGGCCUCGGGCCG | 3926 | 101-123 |
| AD-1019387.1 | GAGUCGGCCCGAGGCCUCCGA | 3860 | 97-117 | UCGGAGGCCUCGGGCCGACUCGC | 3927 | 95-117 |
| AD-1019381.1 | CCCAGAGCCCCAUUCAUUGCA | 3844 | 56-76 | UGCAAUGAAUGGGGCUCUGGGCC | 3911 | 54-76 |

TABLE 20

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1019427 | csgsgga(Chd)GfgGfUfCfca agauggsasa | 3631 | VPusUfsccaUfcUfUfggacCfcGfu cccgsgsc | 3718 | GCCGGGACGGGUCCAAG AUGGAC | 3786 |
| AD-1019428 | gsgsacg(Ghd)GfuCfCfAfag auggacgsga | 3601 | VPusCfsgucCfaUfCfuuggAfcCfc guccscsg | 3688 | CGGGACGGGUCCAAGAU GGACGG | 3767 |
| AD-1019429 | gsascgg(Ghd)UfcCfAfAfga uggacgsgsa | 3599 | VPusCfscguCfcAfUfcuugGfaCfc cgucscsc | 3686 | GGGACGGGUCCAAGAUG GACGGC | 3766 |
| AD-1019430 | ascsggg(Uhd)CfcAfAfGfau ggacggscsa | 3617 | VPusGfsccgUfcCfAfucuuGfgAfc ccguscsc | 3704 | GGACGGGUCCAAGAUGG ACGGCC | 3768 |
| AD-1019431 | uscscaa(Ghd)AfuGfGfAfcg gccgcuscsa | 3600 | VPusGfsagcGfgCfCfguccAfuCfu uggascsc | 3687 | GGUCCAAGAUGGACGGC CGCUCA | 3748 |
| AD-1019432 | asasgau(Ghd)GfaCfGfGfcc gcucagsgsa | 3607 | VPusCfscugAfgCfGfgccgUfcCfa ucuusgsg | 3694 | CCAAGAUGGACGGCCGC UCAGGU | 3772 |
| AD-1019433 | asgsaug(Ghd)AfcGfGfCfcg cucaggsusa | 3610 | VPusAfsccuGfaGfCfggccGfuCfc aucusgsg | 3697 | CAAGAUGGACGGCCGCU CAGGUU | 3774 |
| AD-1019434 | usgsgac(Ghd)GfcCfGfCfuc agguucsusa | 3588 | VPusAfsgaaCfcUfGfagcgGfcCfg uccasusc | 3675 | GAUGGACGGCCGCUCAG GUUCUG | 3756 |
| AD-1019435 | gsgsacg(Ghd)CfcGfCfUfca gguucugsa | 3586 | VPusCfsagaAfcCfUfgagcGfgCfc guccsasu | 3673 | AUGGACGGCCGCUCAGG UUCUGC | 3754 |
| AD-1019436 | ascsggc(Chd)GfcUfCfAfgg uucugcsusa | 3568 | VPusAfsgcaGfaAfCfcugaGfcGfg ccguscsc | 3655 | GGACGGCCGCUCAGGUU CUGCUU | 3742 |
| AD-1019437 | csgsgcc(Ghd)CfuCfAfGfgu ucugcusua | 3583 | VPusAfsagcAfgAfAfccugAfgCfg gccgsusc | 3670 | GACGGCCGCUCAGGUUC UGCUUU | 3753 |
| AD-1019438 | gscscgc(Uhd)CfaGfGfUfuc ugcuuusa | 3559 | VPusAfsaaaGfcAfGfaaccUfgAfg cggcscsg | 3646 | CGGCCGCUCAGGUUCUG CUUUUA | 3733 |

TABLE 20-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1019439 | cscsgcu(Chd)AfgGfUfUfcu gcuuuusasa | 3557 | VPusUfsaaaAfgCfAfgaacCfuGfa gcggscsc | 3644 | GGCCGCUCAGGUUCUGC UUUUAC | 3731 |
| AD-1019440 | csgscuc(Ahd)GfgUfUfCfug cuuuuascsa | 3562 | VPusGfsuaaAfaGfCfagaaCfcUfg agcgsgsc | 3649 | GCCGCUCAGGUUCUGCU UUUACC | 3736 |
| AD-1019441 | gscsuca(Ghd)GfuUfCfUfgc uuuuacscsa | 3578 | VPusGfsguaAfaAfGfcagaAfcCfu gagcsgsg | 3665 | CCGCUCAGGUUCUGCUU UUACCU | 3745 |
| AD-1019442 | csuscag(Ghd)UfuCfUfGfcu uuuaccsusa | 3558 | VPusAfsgguAfaAfAfgcagAfaCfc ugagscsg | 3645 | CGCUCAGGUUCUGCUUU UACCUG | 3732 |
| AD-1019444 | csasggu(Uhd)CfuGfCfUfuu uaccugscsa | 3573 | VPusGfscagGfuAfAfaagcAfgAfa ccugsasg | 3660 | CUCAGGUUCUGCUUUUA CCUGCG | 3746 |
| AD-1019445 | gsgsuuc(Uhd)GfcUfUfUfua ccugcgsgsa | 3612 | VPusCfscgcAfgGfUfaaaaGfcAfg aaccsusg | 3699 | CAGGUUCUGCUUUUACC UGCGGC | 3776 |
| AD-1019446 | usu

scug(Chd)UfuUfUfAfcc ugcggcscsa | 3638 | VPusGfsgccGfcAfGfguaaAfaGfc agaascsc | 3725 | GGUUCUGCUUUUACCUG CGGCCC | 3773 |
| AD-1019447 | cscscag(Ahd)GfcCfCfCfau ucauugscsa | 3616 | VPusGfscaaUfgAfAfugggGfcUfc ugggscsc | 3703 | GGCCCAGAGCCCCAUUC AUUGCC | 3779 |
| AD-1019448 | cscsaga(Ghd)CfcCfCfAfuu cauugcscsa | 3574 | VPusGfsgcaAfuGfAfauggGfgCfu cuggsgsc | 3661 | GCCCAGAGCCCCAUUCA UUGCCC | 3747 |
| AD-1019449 | csasgag(Chd)CfcCfAfUfuc auugccscsa | 3629 | VPusGfsggcAfaUfGfaaugGfgGfc ucugsgsg | 3716 | CCCAGAGCCCCAUUCAU UGCCCC | 3787 |
| AD-1019450 | cscsauu(Chd)AfuUfGfCfcc cggugcsusa | 3597 | VPusAfsgcaCfcGfGfggcaAfuGfa auggsgsg | 3684 | CCCCAUUCAUUGCCCCG GUGCUG | 3764 |

TABLE 21

Unmodified Sense and Antisense Strand Sequences of Huntingtin (HTT) dsRNA Agents

| Duplex Name | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-1019427 | CGGGACGGGUCCAAGAUGGAA | 3851 | 6-26 | UUCCAUCUUGGACCCGUCCCGGC | 3918 | 4-26 |
| AD-1019428 | GGACGGGUCCAAGAUGGACGA | 3832 | 8-28 | UCGUCCAUCUUGGACCCGUCCCG | 3898 | 6-28 |
| AD-1019429 | GACGGGUCCAAGAUGGACGGA | 3831 | 9-29 | UCCGUCCAUCUUGGACCCGUCCC | 3897 | 7-29 |
| AD-1019430 | ACGGGUCCAAGAUGGACGGCA | 3833 | 10-30 | UGCCGUCCAUCUUGGACCCGUCC | 3899 | 8-30 |
| AD-1019431 | UCCAAGAUGGACGGCCGCUCA | 3813 | 15-35 | UGAGCGGCCGUCCAUCUUGGACC | 3878 | 13-35 |
| AD-1019432 | AAGAUGGACGGCCGCUCAGGA | 3837 | 18-38 | UCCUGAGCGGCCGUCCAUCUUGG | 3903 | 16-38 |
| AD-1019433 | AGAUGGACGGCCGCUCAGGUA | 3839 | 19-39 | UACCUGAGCGGCCGUCCAUCUUG | 3906 | 17-39 |
| AD-1019434 | UGGACGGCCGCUCAGGUUCUA | 3821 | 22-42 | UAGAACCUGAGCGGCCGUCCAUC | 3887 | 20-42 |
| AD-1019435 | GGACGGCCGCUCAGGUUCUGA | 3819 | 23-43 | UCAGAACCUGAGCGGCCGUCCAU | 3885 | 21-43 |
| AD-1019436 | ACGGCCGCUCAGGUUCUGCUA | 3807 | 25-45 | UAGCAGAACCUGAGCGGCCGUCC | 3872 | 23-45 |
| AD-1019437 | CGGCCGCUCAGGUUCUGCUUA | 3818 | 26-46 | UAAGCAGAACCUGAGCGGCCGUC | 3884 | 24-46 |
| AD-1019438 | GCCGCUCAGGUUCUGCUUUUA | 3798 | 28-48 | UAAAAGCAGAACCUGAGCGGCCG | 3863 | 26-48 |
| AD-1019439 | CCGCUCAGGUUCUGCUUUUAA | 3796 | 29-49 | UUAAAAGCAGAACCUGAGCGGCC | 3861 | 27-49 |
| AD-1019440 | CGCUCAGGUUCUGCUUUUACA | 3801 | 30-50 | UGUAAAAGCAGAACCUGAGCGGC | 3866 | 28-50 |
| AD-1019441 | GCUCAGGUUCUGCUUUUACCA | 3810 | 31-51 | UGGUAAAAGCAGAACCUGAGCGG | 3875 | 29-51 |

TABLE 21-continued

Unmodified Sense and Antisense Strand Sequences of Huntingtin (HTT) dsRNA Agents

| Duplex Name | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-1019442 | CUCAGGUUCUGCUUUUACCUA | 3797 | 32-52 | UAGGUAAAAGCAGAACCUGAGCG | 3862 | 30-52 |
| AD-1019444 | CAGGUUCUGCUUUUACCUGCA | 3811 | 34-54 | UGCAGGUAAAAGCAGAACCUGAG | 3876 | 32-54 |
| AD-1019445 | GGUUCUGCUUUUACCUGCGGA | 3841 | 36-56 | UCCGCAGGUAAAAGCAGAACCUG | 3908 | 34-56 |
| AD-1019446 | UUCUGCUUUUACCUGCGGCCA | 3838 | 38-58 | UGGCCGCAGGUAAAAGCAGAACC | 3904 | 36-58 |
| AD-1019447 | CCCAGAGCCCCAUUCAUUGCA | 3844 | 56-76 | UGCAAUGAAUGGGGCUCUGGGCC | 3911 | 54-76 |
| AD-1019448 | CCAGAGCCCCAUUCAUUGCCA | 3812 | 57-77 | UGGCAAUGAAUGGGGCUCUGGGC | 3877 | 55-77 |
| AD-1019449 | CAGAGCCCCAUUCAUUGCCCA | 3852 | 58-78 | UGGGCAAUGAAUGGGGCUCUGGG | 3919 | 56-78 |
| AD-1019450 | CCAUUCAUUGCCCCGGUGCUA | 3829 | 65-85 | UAGCACCGGGGCAAUGAAUGGGG | 3895 | 63-85 |

TABLE 24

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1019451 | usgscug(Ahd)GfcGfGfCfgccgcgagsusa | 3928 | VPusAfscucGfcGfGfcgccGfcUfcagcascsc | 3968 | GGUGCUGAGCGGCGCCGCGAGUC | 3788 |
| AD-1019452 | gscsuga(Ghd)CfgGfCfGfccgcgaguscsa | 3929 | VPusGfsacuCfgCfGfgcgcCfgCfucagcsasc | 3969 | GUGCUGAGCGGCGCCGCGAGUCG | 3793 |
| AD-1019453 | gsasguc(Ghd)GfcCfCfGfaggccuccsgsa | 3930 | VPusCfsggaGfgCfCfucggGfcCfgacucsgsc | 3970 | GCGAGUCGGCCCGAGGCCUCCGG | 3795 |
| AD-1019454 | asgsucg(Ghd)CfcCfGfAfggccuccgsgsa | 3931 | VPusCfscggAfgGfCfcucgGfgCfcgacuscsg | 3971 | CGAGUCGGCCCGAGGCCUCCGGG | 4008 |
| AD-1019455 | gscsccg(Ahd)GfgCfCfUfccggggacsusa | 3932 | VPusAfsgucCfcCfGfgaggCfcUfcgggcscsg | 3972 | CGGCCCGAGGCCUCCGGGGACUG | 3794 |
| AD-1019456 | cscscga(Ghd)GfcCfUfCfcggggacusgsa | 3933 | VPusCfsaguCfcCfCfggagGfcCfucgggscsc | 3973 | GGCCCGAGGCCUCCGGGGACUGC | 3789 |
| AD-1019457 | cscsgag(Ghd)CfcUfCfCfggggacugscsa | 3934 | VPusGfscagUfcCfCfcggaGfgCfcucggsgsc | 3974 | GCCCGAGGCCUCCGGGGACUGCC | 3792 |
| AD-1019458 | csgsagg(Chd)CfuCfCfGfgggacugcscsa | 3935 | VPusGfsgcaGfuCfCfccggAfgGfccucgsgsg | 3975 | CCCGAGGCCUCCGGGGACUGCCG | 3784 |
| AD-1019459 | gsasggc(Chd)UfcCfGfGfggacugccsgsa | 3936 | VPusCfsggcAfgUfCfcccgGfaGfgccucsgsg | 3976 | CCGAGGCCUCCGGGGACUGCCGU | 3791 |
| AD-1019460 | cscsucc(Ghd)GfgGfAfCfugccgugcscsa | 3937 | VPusGfsgcaCfgGfCfagucCfcCfggaggscsc | 3977 | GGCCUCCGGGGACUGCCGUGCCG | 3770 |
| AD-1019461 | csusccg(Ghd)GfgAfCfUfgccgugccsgsa | 3938 | VPusCfsggcAfcGfGfcaguCfcCfcggagsgsc | 3978 | GCCUCCGGGGACUGCCGUGCCGG | 3780 |
| AD-1019462 | cscsgug(Chd)CfgGfGfCfgggagaccsgsa | 3939 | VPusCfsgguCfuCfCfcgccCfgGfcacggscsa | 3979 | UGCCGUGCCGGGCGGGAGACCGC | 3781 |
| AD-1019463 | ascscgc(Chd)AfuGfGfCfgacccuggsasa | 3940 | VPusUfsccaGfgGfUfcgccAfuGfgcgguscsu | 3980 | AGACCGCCAUGGCGACCCUGGAA | 3783 |
| AD-1019464 | gscscau(Ghd)GfcGfAfCfccuggaaasasa | 3941 | VPusUfsuuuCfcAfGfggucGfcCfauggcsgsg | 3981 | CCGCCAUGGCGACCCUGGAAAAG | 3771 |
| AD-1019465 | cscsaug(Ghd)CfgAfCfCfcuggaaaasgsa | 3942 | VPusCfsuuuUfcCfAfggguCfgCfcauggscsg | 3982 | CGCCAUGGCGACCCUGGAAAAGC | 3750 |

TABLE 24-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-1019466 | asusggc(Ghd)AfcCfCfUfggaaaagcsusa | 3943 | VPusAfsgcuUfuUfCfcaggGfuCfgccausgsg | 3983 | CCAUGGCGACCCUGGAAAAGCUG | 3763 |
| AD-1019467 | usgsgcg(Ahd)CfcCfUfGfgaaaagcusgsa | 3944 | VPusCfsagcUfuUfUfccagGfgUfcgccasusg | 3984 | CAUGGCGACCCUGGAAAAGCUGA | 3790 |
| AD-1019468 | gscsgac(Chd)CfuGfGfAfaaagcugasusa | 3945 | VPusAfsucaGfcUfUfuuccAfgGfgucgcscsa | 3985 | UGGCGACCCUGGAAAAGCUGAUG | 3749 |
| AD-1019469 | csgsacc(Chd)UfgGfAfAfaagcugausgsa | 3946 | VPusCfsaucAfgCfUfuuucCfaGfggucgscsc | 3986 | GGCGACCCUGGAAAAGCUGAUGA | 3759 |
| AD-1019470 | gsasccc(Uhd)GfgAfAfAfagcugaugsasa | 3947 | VPusUfscauCfaGfCfuuuuCfcAfgggucsgsc | 3987 | GCGACCCUGGAAAAGCUGAUGAA | 3760 |
| AD-1019471 | ascsccu(Ghd)GfaAfAfAfgcugaugasasa | 3948 | VPusUfsucaUfcAfGfcuuuUfcCfaggguscsg | 3988 | CGACCCUGGAAAAGCUGAUGAAG | 3738 |
| AD-1019472 | csusgga(Ahd)AfaGfCfUfgaugaaggscsa | 3949 | VPusGfsccuUfcAfUfcagcUfuUfuccagsgsg | 3989 | CCCUGGAAAAGCUGAUGAAGGCC | 3743 |
| AD-1019473 | usgsgaa(Ahd)AfgCfUfGfaugaaggcscsa | 3950 | VPusGfsgccUfuCfAfucagCfuUfuuccasgsg | 3990 | CCUGGAAAAGCUGAUGAAGGCCU | 3740 |
| AD-1019474 | asasagc(Uhd)GfaUfGfAfaggccuucsgsa | 3951 | VPusCfsgaaGfgCfCfuucaUfcAfgcuuususc | 3991 | GAAAAGCUGAUGAAGGCCUUCGA | 3734 |
| AD-1019475 | asasgcu(Ghd)AfuGfAfAfggccuucgsasa | 3952 | VPusUfscgaAfgGfCfcuucAfuCfagcuususu | 3992 | AAAAGCUGAUGAAGGCCUUCGAG | 3785 |
| AD-1019476 | csusgau(Ghd)AfaGfGfCfcuucgaguscsa | 3953 | VPusGfsacuCfgAfAfggccUfuCfaucagscsu | 3993 | AGCUGAUGAAGGCCUUCGAGUCC | 3737 |
| AD-1019477 | usgsaug(Ahd)AfgGfCfCfuucgagucscsa | 3954 | VPusGfsgacUfcGfAfaggcCfuUfcaucasgsc | 3994 | GCUGAUGAAGGCCUUCGAGUCCC | 3755 |
| AD-1019478 | gsasuga(Ahd)GfgCfCfUfucgaguccscsa | 3955 | VPusGfsggaCfuCfGfaaggCfcUfucaucsasg | 3995 | CUGAUGAAGGCCUUCGAGUCCCU | 3758 |
| AD-1019479 | asusgaa(Ghd)GfcCfUfUfcgagucccsusa | 3956 | VPusAfsgggAfcUfCfgaagGfcCfuucauscsa | 3996 | UGAUGAAGGCCUUCGAGUCCCUC | 3769 |
| AD-1019480 | usgsaag(Ghd)CfcUfUfCfgagucccuscsa | 3957 | VPusGfsaggGfaCfUfcgaaGfgCfcuucasusc | 3997 | GAUGAAGGCCUUCGAGUCCCUCA | 3778 |
| AD-1019481 | asasggc(Chd)UfuCfGfAfgucccucasasa | 3958 | VPusUfsugaGfgGfAfcucgAfaGfgccuuscsa | 3998 | UGAAGGCCUUCGAGUCCCUCAAG | 3761 |
| AD-1019482 | gsgsccu(Uhd)CfgAfGfUfcccucaagsusa | 3959 | VPusAfscuuGfaGfGfgacuCfgAfaggccsusu | 3999 | AAGGCCUUCGAGUCCCUCAAGUC | 3777 |
| AD-1019483 | gscscuu(Chd)GfaGfUfCfccucaaguscsa | 3960 | VPusGfsacuUfgAfGfggacUfcGfaaggcscsu | 4000 | AGGCCUUCGAGUCCCUCAAGUCC | 3744 |
| AD-1019484 | cscsuuc(Ghd)AfgUfCfCfcucaagucscsa | 3961 | VPusGfsgacUfuGfAfgggaCfuCfgaaggscsc | 4001 | GGCCUUCGAGUCCCUCAAGUCCU | 3741 |
| AD-1019485 | csusucg(Ahd)GfuCfCfCfucaaguccsusa | 3962 | VPusAfsggaCfuUfGfagggAfcUfcgaagsgsc | 4002 | GCCUUCGAGUCCCUCAAGUCCUU | 3751 |
| AD-1019486 | ususcga(Ghd)UfcCfCfUfcaaguccususa | 3963 | VPusAfsaggAfcUfUfgaggGfaCfucgaasgsg | 4003 | CCUUCGAGUCCCUCAAGUCCUUC | 3765 |
| AD-1019487 | uscsgag(Uhd)CfcCfUfCfaaguccuuscsa | 3964 | VPusGfsaagGfaCfUfugagGfgAfcucgasasg | 4004 | CUUCGAGUCCCUCAAGUCCUUCC | 3762 |
| AD-1019488 | csgsagu(Chd)CfcUfCfAfaguccuucscsa | 3965 | VPusGfsgaaGfgAfCfuugaGfgGfacucgsasa | 4005 | UUCGAGUCCCUCAAGUCCUUCCA | 3739 |

TABLE 24-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-1019489 | gsasguc(Chd)CfuCfAfAfguccuuccsasa | 3966 | VPusUfsggaAfGfGfAfcuugAfGfGfacucsgsa | 4006 | UCGAGUCCCUCAAGUCCUUCCAG | 3752 |
| AD-1019491 | gsusccc(Uhd)CfaAfGfUfccuuccagscsa | 3967 | VPusGfscugGfaAfGfgacuUfgAfgggacsusc | 4007 | GAGUCCCUCAAGUCCUUCCAGCA | 3782 |

TABLE 25

| Unmodified Sense and Antisense Strand Sequences of Huntingtin (HTT) dsRNA Agents | | | | | | |
|---|---|---|---|---|---|---|
| Duplex Name | Sense Sequence 5' to 3' | SEQ ID NO: | Range in NM_002111.8 | Antisense Sequence 5' to 3' | SEQ ID NO: | Range in NM_002111.8 |
| AD-1019451 | UGCUGAGCGGCGCCGCGAGUA | 3853 | 81-101 | UACUCGCGGCGCCGCUCAGCACC | 3920 | 79-101 |
| AD-1019452 | GCUGAGCGGCGCCGCGAGUCA | 3858 | 82-102 | UGACUCGCGGCGCCGCUCAGCAC | 3925 | 80-102 |
| AD-1019453 | GAGUCGGCCCGAGGCCUCCGA | 3860 | 97-117 | UCGGAGGCCUCGGGCCGACUCGC | 3927 | 95-117 |
| AD-1019454 | AGUCGGCCCGAGGCCUCCGGA | 4009 | 98-118 | UCCGGAGGCCUCGGGCCGACUCG | 4010 | 96-118 |
| AD-1019455 | GCCCGAGGCCUCCGGGGACUA | 3859 | 103-123 | UAGUCCCCGGAGGCCUCGGGCCG | 3926 | 101-123 |
| AD-1019456 | CCCGAGGCCUCCGGGGACUGA | 3854 | 104-124 | UCAGUCCCCGGAGGCCUCGGGCC | 3921 | 102-124 |
| AD-1019457 | CCGAGGCCUCCGGGGACUGCA | 3857 | 105-125 | UGCAGUCCCCGGAGGCCUCGGGC | 3924 | 103-125 |
| AD-1019458 | CGAGGCCUCCGGGGACUGCCA | 3849 | 106-126 | UGGCAGUCCCCGGAGGCCUCGGG | 4011 | 104-126 |
| AD-1019459 | GAGGCCUCCGGGGACUGCCGA | 3856 | 107-127 | UCGGCAGUCCCCGGAGGCCUCGG | 3923 | 105-127 |
| AD-1019460 | CCUCCGGGGACUGCCGUGCCA | 3835 | 111-131 | UGGCACGGCAGUCCCCGGAGGCC | 3901 | 109-131 |
| AD-1019461 | CUCCGGGGACUGCCGUGCCGA | 3845 | 112-132 | UCGGCACGGCAGUCCCCGGAGGC | 3912 | 110-132 |
| AD-1019462 | CCGUGCCGGGCGGGAGACCGA | 3846 | 124-144 | UCGGUCUCCCGCCCGGCACGGCA | 4012 | 122-144 |
| AD-1019463 | ACCGCCAUGGCGACCCUGGAA | 3848 | 140-160 | UUCCAGGGUCGCCAUGGCGGUCU | 3915 | 138-160 |
| AD-1019464 | GCCAUGGCGACCCUGGAAAAA | 3836 | 143-163 | UUUUUCCAGGGUCGCCAUGGCGG | 3902 | 141-163 |
| AD-1019465 | CCAUGGCGACCCUGGAAAAGA | 3815 | 144-164 | UCUUUUCCAGGGUCGCCAUGGCG | 3880 | 142-164 |
| AD-1019466 | AUGGCGACCCUGGAAAAGCUA | 3828 | 146-166 | UAGCUUUUCCAGGGUCGCCAUGG | 4013 | 144-166 |
| AD-1019467 | UGGCGACCCUGGAAAAGCUGA | 3855 | 147-167 | UCAGCUUUUCCAGGGUCGCCAUG | 4014 | 145-167 |
| AD-1019468 | GCGACCCUGGAAAAGCUGAUA | 3814 | 149-169 | UAUCAGCUUUUCCAGGGUCGCCA | 3879 | 147-169 |
| AD-1019469 | CGACCCUGGAAAAGCUGAUGA | 3824 | 150-170 | UCAUCAGCUUUUCCAGGGUCGCC | 3890 | 148-170 |
| AD-1019470 | GACCCUGGAAAAGCUGAUGAA | 3825 | 151-171 | UUCAUCAGCUUUUCCAGGGUCGC | 3891 | 149-171 |
| AD-1019471 | ACCCUGGAAAAGCUGAUGAAA | 3803 | 152-172 | UUUCAUCAGCUUUUCCAGGGUCG | 3868 | 150-172 |
| AD-1019472 | CUGGAAAAGCUGAUGAAGGCA | 3808 | 155-175 | UGCCUUCAUCAGCUUUUCCAGGG | 3873 | 153-175 |
| AD-1019473 | UGGAAAAGCUGAUGAAGGCCA | 3805 | 156-176 | UGGCCUUCAUCAGCUUUUCCAGG | 4015 | 154-176 |
| AD-1019474 | AAAGCUGAUGAAGGCCUUCGA | 3799 | 160-180 | UCGAAGGCCUUCAUCAGCUUUUC | 3864 | 158-180 |
| AD-1019475 | AAGCUGAUGAAGGCCUUCGAA | 3850 | 161-181 | UUCGAAGGCCUUCAUCAGCUUUU | 3917 | 159-181 |
| AD-1019476 | CUGAUGAAGGCCUUCGAGUCA | 3802 | 164-184 | UGACUCGAAGGCCUUCAUCAGCU | 3867 | 162-184 |
| AD-1019477 | UGAUGAAGGCCUUCGAGUCCA | 3820 | 165-185 | UGGACUCGAAGGCCUUCAUCAGC | 3886 | 163-185 |
| AD-1019478 | GAUGAAGGCCUUCGAGUCCCA | 3823 | 166-186 | UGGGACUCGAAGGCCUUCAUCAG | 4016 | 164-186 |
| AD-1019479 | AUGAAGGCCUUCGAGUCCCUA | 3834 | 167-187 | UAGGGACUCGAAGGCCUUCAUCA | 3900 | 165-187 |

TABLE 25-continued

Unmodified Sense and Antisense Strand Sequences of Huntingtin (HTT) dsRNA Agents

| Duplex Name | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-1019480 | UGAAGGCCUUCGAGUCCCUCA | 3843 | 168-188 | UGAGGGACUCGAAGGCCUUCAUC | 3910 | 166-188 |
| AD-1019481 | AAGGCCUUCGAGUCCCUCAAA | 3826 | 170-190 | UUUGAGGGACUCGAAGGCCUUCA | 3892 | 168-190 |
| AD-1019482 | GGCCUUCGAGUCCCUCAAGUA | 3842 | 172-192 | UACUUGAGGGACUCGAAGGCCUU | 3909 | 170-192 |
| AD-1019483 | GCCUUCGAGUCCCUCAAGUCA | 3809 | 173-193 | UGACUUGAGGGACUCGAAGGCCU | 3874 | 171-193 |
| AD-1019484 | CCUUCGAGUCCCUCAAGUCCA | 3806 | 174-194 | UGGACUUGAGGGACUCGAAGGCC | 4017 | 172-194 |
| AD-1019485 | CUUCGAGUCCCUCAAGUCCUA | 3816 | 175-195 | UAGGACUUGAGGGACUCGAAGGC | 4018 | 173-195 |
| AD-1019486 | UUCGAGUCCCUCAAGUCCUUA | 3830 | 176-196 | UAAGGACUUGAGGGACUCGAAGG | 3896 | 174-196 |
| AD-1019487 | UCGAGUCCCUCAAGUCCUUCA | 3827 | 177-197 | UGAAGGACUUGAGGGACUCGAAG | 3893 | 175-197 |
| AD-1019488 | CGAGUCCCUCAAGUCCUUCCA | 3804 | 178-198 | UGGAAGGACUUGAGGGACUCGAA | 3869 | 176-198 |
| AD-1019489 | GAGUCCCUCAAGUCCUUCCAA | 3817 | 179-199 | UUGGAAGGACUUGAGGGACUCGA | 3883 | 177-199 |
| AD-1019491 | GUCCCUCAAGUCCUUCCAGCA | 3847 | 181-201 | UGCUGGAAGGACUUGAGGGACUC | 3914 | 179-201 |

TABLE 27

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1289928.1 | ascscc(Uhd)ggaAfAfAfgcugaugaaaL96 | 4019 | VPusUfsucdAu(C2p)agcuuuUfcCfagggususc | 4070 | CGACCCUGGAAAAGCUGAUGAAG | 3738 |
| AD-1289833.1 | cscsaucg(Chd)gAfCfCfcuggaaaagaL96 | 4020 | VPusCfsuudTu(C2p)caggguCfgCfgauggscsg | 4071 | CGCCAUGGCGACCCUGGAAAAGC | 3750 |
| AD-1289929.1 | cscsuggaAfAfAfgcuga(Uhd)gaaaL96 | 4021 | VPusUfsucdAu(C2p)agcuuuUfcCfaggsgsu | 4072 | ACCCUGGAAAAGCUGAUGAAG | 4134 |
| AD-1289927.1 | cscs(Uhd)ggaAfAfAfguugaugaaaL96 | 4022 | VPusUfsucdAudCaacuuuUfcCfaggsgsu | 4073 | ACCCUGGAAAAGCUGAUGAAG | 4134 |
| AD-1289826.1 | cscsaugg(Chd)gAfCfCfcuggaaaagaL96 | 4023 | VPusCfsuudTudCcaggguCfgCfcauggscsg | 4074 | CGCCAUGGCGACCCUGGAAAAGC | 3750 |
| AD-1289831.1 | asusgg(Chd)gAfCfCfcuggaaaagaL96 | 4024 | VPusCfsuudTu(C2p)caggguCfgCfcausgsg | 4075 | CCAUGGCGACCCUGGAAAAGC | 4135 |
| AD-1289925.1 | ascscc(Uhd)ggaAfAfAfgcugaugaaaL96 | 4019 | VPusUfsucdAu(C2p)agcuuuUfcCfaggguscsg | 4076 | CGACCCUGGAAAAGCUGAUGAAG | 3738 |
| AD-1289824.1 | cscsaugg(Chd)gAfCfCfcuggaaaagaL96 | 4023 | VPusCfsuuuUfcCfAfggguCfgCfcauggscsg | 3982 | CGCCAUGGCGACCCUGGAAAAGC | 3750 |
| AD-1289832.1 | asusgg(Chd)gAfCfCfcuggaaaagaL96 | 4024 | VPusCfsuudTu(C2p)caggguCfgCfcaususc | 4077 | CCAUGGCGACCCUGGAAAAGC | 4135 |
| AD-1289825.1 | cscsauggcgAfCfCfcugg(Ahd)aaagaL96 | 4025 | VPusCfsuuuUfcCfAfggguCfgCfcauggscsg | 3982 | CGCCAUGGCGACCCUGGAAAAGC | 3750 |
| AD-1289852.1 | cscsgcucAfgGfUfUfcugcu(Uhd)uuaaL96 | 4026 | VPusUfsaadAadGcagaacCfudGagcggscsc | 4078 | GGCCGCUCAGGUUCUGCUUUUAC | 3731 |
| AD-1289867.1 | csusu(Chd)GfaGfUfCfccucaagucaL96 | 4027 | VPusdGsacdTu(G2p)agggacUfcGfaagsgsc | 4079 | GCCUUCGAGUCCCUCAAGUCC | 4136 |
| AD-1289924.1 | ascsccuggaAfAfAfgcuga(Uhd)gaaaL96 | 4028 | VPusUfsucau(C2p)agcuuuUfcCfagggusc sg | 3651 | CGACCCUGGAAAAGCUGAUGAAG | 3738 |

TABLE 27-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1289853.1 | cscsgcu(Chd)AfgGfUfUfcugauuuuaaL96 | 4029 | VPusUfsaadAadTcagaacCfudGagcggscsc | 4080 | GGCCGCUCAGGUUCUGCUUUUAC | 3731 |
| AD-1289860.1 | cscsggu(Chd)AfgGfUfUfcugcuuuuaaL96 | 4030 | VPusUfsaadAadGcagaacCfudGaccggscsc | 4081 | GGCCGCUCAGGUUCUGCUUUUAC | 3731 |
| AD-1289931.1 | cscs(Ahd)ggaAfAfAfgcugaugaaaL96 | 4031 | VPusUfsucdAu(C2p)agcuuuUfcCfuggsgsu | 4082 | ACCCUGGAAAAGCUGAUGAAG | 4134 |
| AD-1289926.1 | cscs(Uhd)ggaAfAfAfgcuuaugaaaL96 | 4032 | VPusUfsucdAudAagcuuuUfcCfaggsgsu | 4083 | ACCCUGGAAAAGCUGAUGAAG | 4134 |
| AD-1289851.1 | cscsgcu(Chd)AfgGfUfUfcugcuuuuaaL96 | 3585 | VPusUfsaadAadGcagaacCfudGagcggscsc | 4078 | GGCCGCUCAGGUUCUGCUUUUAC | 3731 |
| AD-1289930.1 | cscsuggaAfAfAfgcuga(Uhd)gaaaL96 | 4021 | VPusUfsucdAu(C2p)agcuuuUfcCfaggsusc | 4084 | ACCCUGGAAAAGCUGAUGAAG | 4134 |
| AD-1289859.1 | cscsgca(Chd)AfgGfUfUfcugcuuuuaaL96 | 4033 | VPusUfsaadAadGcagaacCfudGugcggscsc | 4085 | GGCCGCUCAGGUUCUGCUUUUAC | 3731 |
| AD-1289932.1 | csgs(Uhd)ggaAfAfAfgcugaugaaaL96 | 4034 | VPusUfsucdAu(C2p)agcuuuUfcCfacgsgsu | 4086 | ACCCUGGAAAAGCUGAUGAAG | 4134 |
| AD-1019405.3 | ascsccu(Ghd)GfaAfAfAfgcugaugaaaL96 | 3564 | VPusUfsucau(C2p)agcuuuUfcCfagggguscsg | 3651 | CGACCCUGGAAAAGCUGAUGAAG | 3738 |
| AD-1289861.1 | cscsccu(Chd)AfgGfUfUfcugcuuuuaaL96 | 4035 | VPusUfsaadAadGcagaacCfudGaggggscsc | 4087 | GGCCGCUCAGGUUCUGCUUUUAC | 3731 |
| AD-1107447.5 | cscsaug(Ghd)CfgAfCfCfcuggaaaagaL96 | 3579 | VPusCfsuuuUfcCfAfggguCfgCfcauggscsg | 3982 | CGCCAUGGCGACCCUGGAAAAGC | 3750 |
| AD-1289948.1 | uscsccu(Chd)AfagUfCfcuuccagcaaL96 | 4036 | VPusUfsgcdTg(G2p)aaggacUfudGagggasusc | 4088 | AGUCCCUCAAGUCCUUCCAGCAG | 3735 |
| AD-1289864.1 | gscscuu(Chd)GfaGfUfCfccucaagucaL96 | 3570 | VPusdGsacdTu(G2p)agggacUfcGfaaggcscsu | 4089 | AGGCCUUCGAGUCCCUCAAGUCC | 3744 |
| AD-1289913.1 | gscsgac(Chd)CfudGgAfaaagcugauaL96 | 4037 | VPusAfsucdAg(C2p)uuuccAfgdGgucgcscsg | 4090 | UGGCGACCCUGGAAAAGCUGAUG | 3749 |
| AD-1289923.1 | ascscc(Uhd)ggaAfAfAfgcugaugaaaL96 | 4019 | VPusUfsucau(C2p)agcuuuUfcCfagggguscsg | 3651 | CGACCCUGGAAAAGCUGAUGAAG | 3738 |
| AD-1289921.1 | gscsguc(Chd)CfudGgAfaaagcugauaL96 | 4038 | VPusAfsucdAg(C2p)uuuccAfgdGgacgcscsg | 4091 | UGGCGACCCUGGAAAAGCUGAUG | 3749 |
| AD-1289865.1 | gscscuu(Chd)GfaGfUfCfccuuaagucaL96 | 4039 | VPusdGsacdTudAagggacUfcGfaaggcscsu | 4092 | AGGCCUUCGAGUCCCUCAAGUCC | 3744 |
| AD-1107442.5 | cscsgcu(Chd)AfgGfUfUfcugcuuuuaaL96 | 3585 | VPusUfsaaaAfgCfAfgaacCfuGfagcggscsc | 3644 | GGCCGCUCAGGUUCUGCUUUUAC | 3731 |
| AD-1289830.1 | cscsaugg(Uhd)gAfCfCfcuggaaaagaL96 | 4040 | VPusCfsuudTudCcagguCfaCfcauggsusc | 4093 | CCAUGGCGACCCUGGAAAAGC | 4135 |
| AD-1289866.1 | gscscuu(Chd)GfaGfUfCfccucaagucaL96 | 3570 | VPusdGsacdTu(G2p)agggacUfcGfaaggcsusc | 4094 | AGGCCUUCGAGUCCCUCAAGUCC | 3744 |
| AD-1289947.1 | uscsccu(Chd)AfagUfCfcuuccagcaaL96 | 4036 | VPusUfsgcdTg(G2p)aaggacUfudGagggascsu | 4095 | AGUCCCUCAAGUCCUUCCAGCAG | 3735 |
| AD-1289933.1 | gscs(Uhd)ggaAfAfAfgcugaugaaaL96 | 4041 | VPusUfsucdAu(C2p)agcuuuUfcCfagcsgsu | 4096 | ACCCUGGAAAAGCUGAUGAAG | 4134 |
| AD-1289950.1 | uscscca(Chd)AfagUfCfcuuccagcaaL96 | 4042 | VPusUfsgcdTg(G2p)aaggacUfudGugggascsu | 4097 | AGUCCCUCAAGUCCUUCCAGCAG | 3735 |
| AD-1289868.1 | csusu(Chd)GfaGfUfCfccucaagucaL96 | 4027 | VPusdGsacdTu(G2p)agggacUfcGfaagscsu | 4098 | GCCUUCGAGUCCCUCAAGUCC | 4136 |
| AD-1289946.1 | uscsgcu(Chd)AfaGfUfCfcuuucagcaaL96 | 4043 | VPusUfsgcdTgdAaaggacUfuGfagcgascsu | 4099 | AGUCCCUCAAGUCCUUCCAGCAG | 3735 |

TABLE 27-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1289960.1 | gscsguc(Chd)CfudGgAfaaagcugauaL96 | 4038 | VPusAfsucdAg(C2p)uuuudCcAfgdGgacgcsusc | 4100 | UGGCGACCCUGGAAAAGCUGAUG | 3749 |
| AD-1289956.1 | gscsgac(Chd)CfudGgAfaaagcugauaL96 | 4037 | VPusAfsucdAgdCuuuudCcAfgdGgucgcscsg | 4101 | UGGCGACCCUGGAAAAGCUGAUG | 3749 |
| AD-1289827.1 | cscsaugg(Chd)gAfCfCfcuggaaaagaL96 | 4023 | VPusCfsuudTu(C2p)caggguCfgCfcauggcscsg | 4102 | CGCCAUGGCGACCCUGGAAAAGC | 3750 |
| AD-1289829.1 | cscsaugg(Chd)gAfUfCfcuggaaaagaL96 | 4044 | VPusCfsuudTudCcaggauCfgCfcauggsusc | 4103 | CGCCAUGGCGACCCUGGAAAAGC | 3750 |
| AD-1289850.1 | cscsgcu(Chd)aggUfUfcugcuuuuaaL96 | 4045 | VPusUfsaaaAfgCfAfgaacCfuGfagcggscsc | 3644 | GGCCGCUCAGGUUCUGCUUUUAC | 3731 |
| AD-1289945.1 | uscsccu(Chd)AfaGfUfCfcuuucagcaaL96 | 4046 | VPusUfsgcdTgdAaaggacUfuGfagggascsu | 4104 | AGUCCCUCAAGUCCUUCCAGCAG | 3735 |
| AD-1289835.1 | cscsuugg(Chd)gAfCfCfcuggaaaagaL96 | 4047 | VPusCfsuudTu(C2p)caggguCfgCfcaaggscsg | 4105 | CGCCAUGGCGACCCUGGAAAAGC | 3750 |
| AD-1289828.1 | cscsaugg(Chd)gAfCfCfcuggaaaagaL96 | 4023 | VPusCfsuudTu(C2p)caggguCfgCfcauggsusc | 4106 | CGCCAUGGCGACCCUGGAAAAGC | 3750 |
| AD-1289949.1 | cscsu(Chd)AfagUfCfcuuccagcaaL96 | 4048 | VPusUfsgcdTg(G2p)aaggacUfudGaggscsg | 4107 | UCCCUCAAGUCCUUCCAGCAG | 4137 |
| AD-1289871.1 | gscsguu(Chd)GfaGfUfCfccucaagucaL96 | 4049 | VPusdGsacdTu(G2p)agggacUfcGfaacgcscsu | 4108 | AGGCCUUCGAGUCCCUCAAGUCC | 3744 |
| AD-1289914.1 | gscsgac(Chd)CfudGgAfaaagcugauaL96 | 4037 | VPusAfsucdAg(C2p)uuudCcAfgdGgucgcscsg | 4109 | UGGCGACCCUGGAAAAGCUGAUG | 3749 |
| AD-1289911.1 | gscsgaccCfuGfGfAfaaagc(Uhd)gauaL96 | 4050 | VPusAfsucag(C2p)uuuccAfgGfgucgcscsa | 3664 | UGGCGACCCUGGAAAAGCUGAUG | 3749 |
| AD-1289857.1 | gscsu(Chd)AfgGfUfUfcugcuuuuaaL96 | 4051 | VPusUfsaadAadGcagaacCfudGagcsusg | 4110 | CCGCUCAGGUUCUGCUUUUAC | 4138 |
| AD-1289944.1 | uscsccucAfaGfUfCfcuucc(Ahd)gcaaL96 | 4052 | VPusUfsgcug(G2p)aaggacUfuGfagggascsu | 3648 | AGUCCCUCAAGUCCUUCCAGCAG | 3735 |
| AD-1289957.1 | gscsgac(Chd)CfuGfGfAfaaagcugauaL96 | 3577 | VPusAfsucdAg(C2p)uuudCcAfgdGgucgcscsg | 4109 | UGGCGACCCUGGAAAAGCUGAUG | 3749 |
| AD-1289955.1 | gscsgac(Chd)CfudGgAfaaagcugauaL96 | 4037 | VPusAfsucaGfcUfUfuuccAfgGfgucgcscsg | 4111 | UGGCGACCCUGGAAAAGCUGAUG | 3749 |
| AD-1289834.1 | cscsaagg(Chd)gAfCfCfcuggaaaagaL96 | 4053 | VPusCfsuudTu(C2p)caggguCfgCfcuuggscsg | 4112 | CGCCAUGGCGACCCUGGAAAAGC | 3750 |
| AD-1289855.1 | cscsgcu(Chd)agdGuUfcugcuuuuaaL96 | 4054 | VPusUfsaadAadGcagadAcCfudGagcggscsc | 4113 | GGCCGCUCAGGUUCUGCUUUUAC | 3731 |
| AD-1019402.3 | gscsgac(Chd)CfuGfGfAfaaagcugauaL96 | 3577 | VPusAfsucag(C2p)uuuccAfgGfgucgcscsa | 3664 | UGGCGACCCUGGAAAAGCUGAUG | 3749 |
| AD-1289954.1 | gsasccCfuGfGfAfaaugc(Uhd)gauaL96 | 4055 | VPusAfsucdAgdCauudCcAfgdGgucsusc | 4114 | GCGACCCUGGAAAAGCUGAUG | 4139 |
| AD-1289920.1 | gscsgag(Chd)CfudGgAfaaagcugauaL96 | 4056 | VPusAfsucdAg(C2p)uuuuccAfgdGcucgcscsg | 4115 | UGGCGACCCUGGAAAAGCUGAUG | 3749 |
| AD-1019426.3 | uscsccu(Chd)AfaGfUfCfcuuccagcaaL96 | 3561 | VPusUfsgcug(G2p)aaggacUfuGfagggascsu | 3648 | AGUCCCUCAAGUCCUUCCAGCAG | 3735 |
| AD-1289862.1 | cscsgcu(Chd)agGfUfUfcugcuuuuaaL96 | 4057 | VPusdTsaadAadGcagadAcCfudGagcggscsc | 4116 | GGCCGCUCAGGUUCUGCUUUUAC | 3731 |
| AD-1289854.1 | cscsgcu(Chd)aggUfUfcugcuuuuaaL96 | 4045 | VPusUfsaadAadGcagaacCfudGagcggscsc | 4078 | GGCCGCUCAGGUUCUGCUUUUAC | 3731 |

TABLE 27-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-1289914.2 | gscsgac(Chd)CfudGgAfaaagcugauaL96 | 4037 | VPusAfsucdAg(C2p)uuudCcAfgdGgucgcscsg | 4109 | UGGCGACCCUGGAAAAGCUGAUG | 3749 |
| AD-1289915.1 | gscsgac(Chd)CfudGgAfaaagcugauaL96 | 4037 | VPusAfsucdAg(C2p)uuudCcAfgdGgucgcsusg | 4117 | UGGCGACCCUGGAAAAGCUGAUG | 3749 |
| AD-1107449.5 | gscsgac(Chd)CfuGfGfAfaaagcugauaL96 | 3577 | VPusAfsucaGfcUfUfuuccAfgGfgucgcscsa | 3985 | UGGCGACCCUGGAAAAGCUGAUG | 3749 |
| AD-1289870.1 | gscscau(Chd)GfaGfUfCfccucaagucaL96 | 4058 | VPusdGsacdTu(G2p)agggacUfcGfauggcscsu | 4118 | AGGCCUUCGAGUCCCUCAAGUCC | 3744 |
| AD-1289953.1 | gscsgaccCfuGfGfAfaaagc(Uhd)gauaL96 | 4050 | VPusAfsucaGfcUfUfuuccAfgGfgucgcscsg | 4111 | UGGCGACCCUGGAAAAGCUGAUG | 3749 |
| AD-1107451.5 | gscscuu(Chd)GfaGfUfCfccucaagucaL96 | 3570 | VPusGfsacuUfgAfGfggacUfcGfaaggcscsu | 4000 | AGGCCUUCGAGUCCCUCAAGUCC | 3744 |
| AD-1289961.1 | gscscac(Chd)CfudGgAfaaagcugauaL96 | 4059 | VPusAfsucdAg(C2p)uuudCcAfgdGguggcsusc | 4119 | CCAUGGCGACCCUGGAAAAGC | 4135 |
| AD-1289951.1 | uscscgu(Chd)AfagUfCfcuuccagcaaL96 | 4060 | VPusUfsgcdTg(G2p)aaggacUfudGacggascsu | 4120 | AGUCCCUCAAGUCCUUCCAGCAG | 3735 |
| AD-1289915.2 | gscsgac(Chd)CfudGgAfaaagcugauaL96 | 4037 | VPusAfsucdAg(C2p)uuudCcAfgdGgucgcsusg | 4117 | UGGCGACCCUGGAAAAGCUGAUG | 3749 |
| AD-1289912.1 | gscsgac(Chd)CfudGgAfaaagcugauaL96 | 4037 | VPusAfsucag(C2p)uuuuccAfgGfgucgcscsg | 4121 | UGGCGACCCUGGAAAAGCUGAUG | 3749 |
| AD-1289958.1 | gsasc(Chd)CfudGgAfaaagcugauaL96 | 4061 | VPusAfsucdAg(C2p)uuudCcAfgdGgucsusg | 4122 | GCGACCCUGGAAAAGCUGAUG | 4139 |
| AD-1289869.1 | gscscua(Chd)GfaGfUfCfccucaagucaL96 | 4062 | VPusdGsacdTu(G2p)agggacUfcGfuaggcscsu | 4123 | AGGCCUUCGAGUCCCUCAAGUCC | 3744 |
| AD-1289916.2 | gsasc(Chd)CfudGgAfaaagcugauaL96 | 4061 | VPusAfsucdAg(C2p)uuudCcAfgdGgucsgsc | 4124 | GCGACCCUGGAAAAGCUGAUG | 4139 |
| AD-1289858.1 | gscsu(Chd)AfgGfUfUfcugcuuuuaaL96 | 4051 | VPusUfsaadAa(G2p)cagaacCfudGagcsusg | 4125 | CCGCUCAGGUUCUGCUUUUAC | 4138 |
| AD-1289789.1 | csasgcu(Uhd)CfcUfCfAfgccgccgccaL96 | 4063 | VPusGfsgcgGfcGfGfcugaGfgAfagcugsasg | 4126 | CUCAGCUUCCUCAGCCGCCGCCG | 4140 |
| AD-1255821.1 | uscsagc(Uhd)UfcCfUfCfagccgccgcaL96 | 4064 | VPusGfscggCfgGfCfugagGfaAfgcugasgsg | 4127 | CCUCAGCUUCCUCAGCCGCCGCC | 4141 |
| AD-1289959.1 | gscsgag(Chd)CfudGgAfaaagcugauaL96 | 4056 | VPusAfsucdAg(C2p)uuudCcAfgdGcucgcsusc | 4128 | UGGCGACCCUGGAAAAGCUGAUG | 3749 |
| AD-1289790.1 | asgscuu(Chd)CfuCfAfGfccgccgccgaL96 | 4065 | VPusCfsggcGfgCfGfgcugAfgGfaagcusgsa | 4129 | UCAGCUUCCUCAGCCGCCGCCGC | 4142 |
| AD-1289952.1 | uscsgcu(Chd)AfagUfCfcuuccagcaaL96 | 4066 | VPusUfsgcdTg(G2p)aaggacUfudGagcgascsu | 4130 | AGUCCCUCAAGUCCUUCCAGCAG | 3735 |
| AD-1289791.1 | gscsuuc(Chd)UfcAfGfCfcgccgccgcaL96 | 4067 | VPusGfscggCfgGfCfggcuGfaGfgaagcsusg | 4131 | CAGCUUCCUCAGCCGCCGCCGCA | 4143 |
| AD-1289922.1 | gscscac(Chd)CfudGgAfaaagcugauaL96 | 4059 | VPusAfsucdAg(C2p)uuuccAfgdGguggcscsg | 4132 | UGGCGACCCUGGAAAAGCUGAUG | 3749 |
| AD-1289919.1 | gscsgaccCfuGfGfAfaaugc(Uhd)gauaL96 | 4068 | VPusAfsucdAgdCauuudCcAfgdGgucscsu | 4133 | UGGCGACCCUGGAAAAGCUGAUG | 3749 |
| AD-1289916.1 | gsasc(Chd)CfudGgAfaaagcugauaL96 | 4061 | VPusAfsucdAg(C2p)uuudCcAfgdGgucsgsc | 4124 | GCGACCCUGGAAAAGCUGAUG | 4139 |
| AD-1289863.1 | gscscuu(Chd)gagUfCfccucaagucaL96 | 4069 | VPusGfsacuUfgAfGfggacUfcGfaaggcscsu | 4000 | AGGCCUUCGAGUCCCUCAAGUCC | 3744 |

TABLE 28

Unmodified Sense and Antisense Strand Sequences of Huntingtin (HTT) dsRNA Agents

| Duplex Name | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-1289928.1 | ACCCUGGAAAAGCUGAUGAAA | 3803 | 152-172 | UUUCAUCAGCUUUUCCAGGGUUC | 4182 | 150-172 |
| AD-1289833.1 | CCAUCGCGACCCUGGAAAAGA | 4144 | 144-164 | UCUUUUCCAGGGUCGCGAUGGCG | 4183 | 142-164 |
| AD-1289929.1 | CCUGGAAAAGCUGAUGAAA | 4145 | 154-172 | UUUCAUCAGCUUUUCCAGGGU | 4184 | 152-172 |
| AD-1289927.1 | CCUGGAAAAGUUGAUGAAA | 4146 | 154-172 | UUUCAUCAACUUUUCCAGGGU | 4185 | 152-172 |
| AD-1289826.1 | CCAUGGCGACCCUGGAAAAGA | 3815 | 144-164 | UCUUUCCAGGGUCGCGAUGGCG | 4186 | 142-164 |
| AD-1289831.1 | AUGGCGACCCUGGAAAAGA | 4147 | 146-164 | UCUUUUCCAGGGUCGCCAUGG | 4187 | 144-164 |
| AD-1289925.1 | ACCCUGGAAAAGCUGAUGAAA | 3803 | 152-172 | UUUCAUCAGCUUUUCCAGGGUCG | 3868 | 150-172 |
| AD-1289824.1 | CCAUGGCGACCCUGGAAAAGA | 3815 | 144-164 | UCUUUUCCAGGGUCGCCAUGGCG | 3880 | 142-164 |
| AD-1289832.1 | AUGGCGACCCUGGAAAAGA | 4147 | 146-164 | UCUUUUCCAGGGUCGCCAUUC | 4188 | 144-164 |
| AD-1289825.1 | CCAUGGCGACCCUGGAAAAGA | 3815 | 144-164 | UCUUUUCCAGGGUCGCCAUGGCG | 3880 | 142-164 |
| AD-1289852.1 | CCGCUCAGGUUCUGCUUUUAA | 3796 | 29-49 | UUAAAAGCAGAACCUGAGCGGCC | 3861 | 27-49 |
| AD-1289867.1 | CUUCGAGUCCCUCAAGUCA | 4148 | 175-193 | UGACUUGAGGGACUCGAAGGC | 4189 | 173-193 |
| AD-1289924.1 | ACCCUGGAAAAGCUGAUGAAA | 3803 | 152-172 | UUUCAUCAGCUUUUCCAGGGUCG | 3868 | 150-172 |
| AD-1289853.1 | CCGCUCAGGUUCUGAUUUUAA | 4149 | 29-49 | UUAAAAUCAGAACCUGAGCGGCC | 4190 | 27-49 |
| AD-1289860.1 | CCGGUCAGGUUCUGCUUUUAA | 4150 | 29-49 | UUAAAAGCAGAACCUGACCGGCC | 4191 | 27-49 |
| AD-1289931.1 | CCAGGAAAAGCUGAUGAAA | 4151 | 154-172 | UUUCAUCAGCUUUUCCUGGGU | 4192 | 152-172 |
| AD-1289926.1 | CCUGGAAAAGCUUAUGAAA | 4152 | 154-172 | UUUCAUAAGCUUUUCCAGGGU | 4193 | 152-172 |
| AD-1289851.1 | CCGGUCAGGUUCUGCUUUUAA | 3796 | 29-49 | UUAAAAGCAGAACCUGAGCGGCC | 3861 | 27-49 |
| AD-1289930.1 | CCUGGAAAAGCUGAUGAAA | 4145 | 154-172 | UUUCAUCAGCUUUUCCAGGUC | 4194 | 152-172 |
| AD-1289859.1 | CCGCACAGGUUCUGCUUUUAA | 4153 | 29-49 | UUAAAAGCAGAACCUGUGCGGCC | 4195 | 27-49 |
| AD-1289932.1 | CGUGGAAAAGCUGAUGAAA | 4154 | 154-172 | UUUCAUCAGCUUUUCCACGGU | 4196 | 152-172 |
| AD-1019405.3 | ACCCUGGAAAAGCUGAUGAAA | 3803 | 152-172 | UUUCAUCAGCUUUUCCAGGGUCG | 3868 | 150-172 |
| AD-1289861.1 | CCGGUCAGGUUCUGCUUUUAA | 4155 | 29-49 | UUAAAAGCAGAACCUGAGGGGCC | 4197 | 27-49 |
| AD-1107447.5 | CCAUGGCGACCCUGGAAAAGA | 3815 | 144-164 | UCUUUUCCAGGGUCGCCAUGGCG | 3880 | 142-164 |
| AD-1289948.1 | UCCCUCAAGUCCUUCCAGCAA | 3800 | 182-202 | UUGCUGGAAGGACUUGAGGGAUC | 4198 | 180-202 |
| AD-1289864.1 | GCCUUCGAGUCCCUCAAGUCA | 3809 | 173-193 | UGACUUGAGGGACUCGAAGGCCU | 4199 | 171-193 |
| AD-1289913.1 | GCGACCCUGGAAAAGCUGAUA | 3814 | 149-169 | UAUCAGCUUUUCCAGGGUCGCCG | 4200 | 147-169 |
| AD-1289923.1 | ACCCUGGAAAAGCUGAUGAAA | 3803 | 152-172 | UUUCAUCAGCUUUUCCAGGGUCG | 3868 | 150-172 |
| AD-1289921.1 | GCGUCCCUGGAAAAGCUGAUA | 4156 | 149-169 | UAUCAGCUUUUCCAGGGACGCCG | 4201 | 147-169 |
| AD-1289865.1 | GCCUUCGAGUCCCUUAAGUCA | 4157 | 173-193 | UGACUUAAGGGACUCGAAGGCCU | 4202 | 171-193 |
| AD-1107442.5 | CCGGUCAGGUUCUGCUUUUAA | 3796 | 29-49 | UUAAAAGCAGAACCUGAGCGGCC | 3861 | 27-49 |
| AD-1289830.1 | CCAUGGUGACCCUGGAAAAGA | 4158 | 144-164 | UCUUUUCCAGGGUCACCAUGGUC | 4203 | 142-164 |
| AD-1289866.1 | GCCUUCGAGUCCCUCAAGUCA | 3809 | 173-193 | UGACUUGAGGGACUCGAAGGCUC | 4204 | 171-193 |
| AD-1289947.1 | UCCCUCAAGUCCUUCCAGCAA | 3800 | 182-202 | UUGCUGGAAGGACUUGAGGGACU | 4205 | 180-202 |
| AD-1289933.1 | GCUGGAAAAGCUGAUGAAA | 4159 | 154-172 | UUUCAUCAGCUUUUCCAGCGU | 4206 | 152-172 |
| AD-1289950.1 | UCCCACAAGUCCUUCCAGCAA | 4160 | 182-202 | UUGCUGGAAGGACUUGUGGGACU | 4207 | 180-202 |
| AD-1289868.1 | CUUCGAGUCCCUCAAGUCA | 4148 | 175-193 | UGACUUGAGGGACUCGAAGCU | 4208 | 173-193 |

TABLE 28-continued

| Unmodified Sense and Antisense Strand Sequences of Huntingtin (HTT) dsRNA Agents | | | | | | |
|---|---|---|---|---|---|---|
| Duplex Name | Sense Sequence 5' to 3' | SEQ ID NO: | Range in NM_002111.8 | Antisense Sequence 5' to 3' | SEQ ID NO: | Range in NM_002111.8 |
| AD-1289946.1 | UCGCUCAAGUCCUUUCAGCAA | 4161 | 182-202 | UUGCTGAAAGGACUUGAGCGACU | 4209 | 180-202 |
| AD-1289960.1 | GCGUCCCUGGAAAAGCUGAUA | 4156 | 149-169 | UAUCAGCUUUUCCAGGGACGCUC | 4210 | 147-169 |
| AD-1289956.1 | GCGACCCUGGAAAAGCUGAUA | 3814 | 149-169 | UAUCAGCUUUUCCAGGGUCGCCG | 4200 | 147-169 |
| AD-1289827.1 | CCAUGGCGACCCUGGAAAAGA | 3815 | 144-164 | UCUUTUCCAGGGUCGCCAUGGCG | 4186 | 142-164 |
| AD-1289829.1 | CCAUGGCGAUCCUGGAAAAGA | 4162 | 144-164 | UCUUTUCCAGGAUCGCCAUGGUC | 4211 | 142-164 |
| AD-1289850.1 | CCGCUCAGGUUCUGCUUUUAA | 3796 | 29-49 | UUAAAAGCAGAACCUGAGCGGCC | 3861 | 27-49 |
| AD-1289945.1 | UCCCUCAAGUCCUUUCAGCAA | 4163 | 182-202 | UUGCTGAAAGGACUUGAGGGACU | 4212 | 180-202 |
| AD-1289835.1 | CCUUGGCGACCCUGGAAAAGA | 4164 | 144-164 | UCUUTUCCAGGGUCGCCAAGGCG | 4213 | 142-164 |
| AD-1289828.1 | CCAUGGCGACCCUGGAAAAGA | 3815 | 144-164 | UCUUTUCCAGGGUCGCCAUGGUC | 4214 | 142-164 |
| AD-1289949.1 | CCUCAAGUCCUUCCAGCAA | 4165 | 184-202 | UUGCTGGAAGGACUUGAGGCG | 4215 | 182-202 |
| AD-1289871.1 | GCGUUCGAGUCCCUCAAGUCA | 4166 | 173-193 | UGACTUGAGGGACUCGAACGCCU | 4216 | 171-193 |
| AD-1289914.1 | GCGACCCUGGAAAAGCUGAUA | 3814 | 149-169 | UAUCAGCUUUUCCAGGGUCGCCG | 4200 | 147-169 |
| AD-1289911.1 | GCGACCCUGGAAAAGCUGAUA | 3814 | 149-169 | UAUCAGCUUUUCCAGGGUCGCCA | 3879 | 147-169 |
| AD-1289857.1 | GCUCAGGUUCUGCUUUUAA | 4167 | 31-49 | UUAAAAGCAGAACCUGAGCUG | 4217 | 29-49 |
| AD-1289944.1 | UCCCUCAAGUCCUUCCAGCAA | 3800 | 182-202 | UUGCUGGAAGGACUUGAGGGACU | 3865 | 180-202 |
| AD-1289957.1 | GCGACCCUGGAAAAGCUGAUA | 3814 | 149-169 | UAUCAGCUUUUCCAGGGUCGCCG | 4200 | 147-169 |
| AD-1289955.1 | GCGACCCUGGAAAAGCUGAUA | 3814 | 149-169 | UAUCAGCUUUUCCAGGGUCGCCG | 4200 | 147-169 |
| AD-1289834.1 | CCAAGGCGACCCUGGAAAAGA | 4168 | 144-164 | UCUUTUCCAGGGUCGCCUUGGCG | 4218 | 142-164 |
| AD-1289855.1 | CCGCUCAGGUUCUGCUUUUAA | 3796 | 29-49 | UUAAAAGCAGAACCUGAGCGGCC | 3861 | 27-49 |
| AD-1019402.3 | GCGACCCUGGAAAAGCUGAUA | 3814 | 149-169 | UAUCAGCUUUUCCAGGGUCGCCA | 3879 | 147-169 |
| AD-1289954.1 | GACCCUGGAAAUGCUGAUA | 4169 | 151-169 | UAUCAGCAUUUCCAGGGUCUC | 4219 | 149-169 |
| AD-1289920.1 | GCGAGCCUGGAAAAGCUGAUA | 4170 | 149-169 | UAUCAGCUUUUCCAGGGUCGCCG | 4220 | 147-169 |
| AD-1019426.3 | UCCCUCAAGUCCUUCCAGCAA | 3800 | 182-202 | UUGCUGGAAGGACUUGAGGGACU | 3865 | 180-202 |
| AD-1289862.1 | CCGCUCAGGUUCUGCUUUUAA | 3796 | 29-49 | UTAAAAGCAGAACCUGAGCGGCC | 4221 | 27-49 |
| AD-1289854.1 | CCGCUCAGGUUCUGCUUUUAA | 3796 | 29-49 | UUAAAAGCAGAACCUGAGCGGCC | 3861 | 27-49 |
| AD-1289914.2 | GCGACCCUGGAAAAGCUGAUA | 3814 | 149-169 | UAUCAGCUUUUCCAGGGUCGCCG | 4200 | 147-169 |
| AD-1289915.1 | GCGACCCUGGAAAAGCUGAUA | 3814 | 149-169 | UAUCAGCUUUUCCAGGGUCGCUG | 4222 | 147-169 |
| AD-1107449.5 | GCGACCCUGGAAAAGCUGAUA | 3814 | 149-169 | UAUCAGCUUUUCCAGGGUCGCCA | 3879 | 147-169 |
| AD-1289870.1 | GCCAUCGAGUCCCUCAAGUCA | 4171 | 173-193 | UGACTUGAGGGACUCGAUGGCCU | 4223 | 171-193 |
| AD-1289953.1 | GCGACCCUGGAAAAGCUGAUA | 3814 | 149-169 | UAUCAGCUUUUCCAGGGUCGCCG | 4200 | 147-169 |
| AD-1107451.5 | GCCUUCGAGUCCCUCAAGUCA | 3809 | 173-193 | UGACUUGAGGGACUCGAAGGCCU | 3874 | 171-193 |
| AD-1289961.1 | GCCACCCUGGAAAAGCUGAUA | 4172 | 149-169 | UAUCAGCUUUUCCAGGGUGGCUC | 4224 | 147-169 |
| AD-1289951.1 | UCCGUCAAGUCCUUCCAGCAA | 4173 | 182-202 | UUGCTGGAAGGACUUGACGGACU | 4225 | 180-202 |
| AD-1289915.2 | GCGACCCUGGAAAAGCUGAUA | 3814 | 149-169 | UAUCAGCUUUUCCAGGGUCGCUG | 4222 | 147-169 |
| AD-1289912.1 | GCGACCCUGGAAAAGCUGAUA | 3814 | 149-169 | UAUCAGCUUUUCCAGGGUCGCCG | 4200 | 147-169 |
| AD-1289958.1 | GACCCUGGAAAAGCUGAUA | 4174 | 151-169 | UAUCAGCUUUUCCAGGGUCUG | 4226 | 149-169 |
| AD-1289869.1 | GCCUACGAGUCCCUCAAGUCA | 4175 | 173-193 | UGACTUGAGGGACUCGUAGGCCU | 4227 | 171-193 |

TABLE 28-continued

Unmodified Sense and Antisense Strand Sequences of Huntingtin (HTT) dsRNA Agents

| Duplex Name | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-1289916.2 | GACCCUGGAAAAGCUGAUA | 4174 | 151-169 | UAUCAGCUUUUCCAGGGUCGC | 4228 | 149-169 |
| AD-1289858.1 | GCUCAGGUUCUGCUUUUAA | 4167 | 31-49 | UUAAAAGCAGAACCUGAGCUG | 4217 | 29-49 |
| AD-1289789.1 | CAGCUUCCUCAGCCGCCGCCA | 4176 | 299-319 | UGGCGGCGGCUGAGGAAGCUGAG | 4229 | 297-319 |
| AD-1255821.1 | UCAGCUUCCUCAGCCGCCGCA | 4177 | 298-318 | UGCGGCGGCUGAGGAAGCUGAGG | 4230 | 296-318 |
| AD-1289959.1 | GCGAGCCUGGAAAAGCUGAUA | 4170 | 149-169 | UAUCAGCUUUUCCAGGCUCGCUC | 4231 | 147-149 |
| AD-1289790.1 | AGCUUCCUCAGCCGCCGCCGA | 4178 | 300-320 | UCGGCGGCGGCUGAGGAAGCUGA | 4232 | 298-320 |
| AD-1289952.1 | UCGCUCAAGUCCUUCCAGCAA | 4179 | 182-202 | UUGCUGGAAGGACUUGAGCGACU | 4233 | 180-202 |
| AD-1289791.1 | GCUUCCUCAGCCGCCGCCGCA | 4180 | 301-321 | UGCGGCGGCGGCUGAGGAAGCUG | 4234 | 299-321 |
| AD-1289922.1 | GCGACCCUGGAAAAGCUGAUA | 4172 | 149-169 | UAUCAGCUUUUCCAGGGUGGCCG | 4235 | 147-169 |
| AD-1289919.1 | GCGACCCUGGAAAUGCUGAUA | 4181 | 149-169 | UAUCAGCAUUUCCAGGGUCCU | 4236 | 147-169 |
| AD-1289916.1 | GACCCUGGAAAAGCUGAUA | 4174 | 151-169 | UAUCAGCUUUUCCAGGGUCGC | 4228 | 149-169 |
| AD-1289863.1 | GCCUUCGAGUCCCUCAAGUCA | 3809 | 173-193 | UGACUUGAGGGACUCGAAGGCCU | 3874 | 171-193 |

TABLE 29

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1255829.1 | ascsagc(Chd)GfcUfGfCfugccucagcaL96 | 4237 | VPusGfscugAfgGfCfagcaGfcGfgcugusgsc | 4282 | GCACAGCCGCUGCUGCCUCAGCC | 4327 |
| AD-1289804.1 | cscsgcc(Ghd)CfaGfGfCfacagccgcuaL96 | 4238 | VPusAfsgcgGfcUfGfugccUfgCfggcggscsg | 4283 | CGCCGCCGCAGGCACAGCCGCUG | 4328 |
| AD-1255847.1 | usgsagg(Ahd)GfcCfGfCfugcaccgacaL96 | 4239 | VPusGfsucgGfuGfCfagcgGfcUfccucasgsc | 4284 | GCUGAGGAGCCGCUGCACCGACC | 4329 |
| AD-1255846.1 | csusgag(Ghd)AfgCfCfGfcugcaccgaaL96 | 4240 | VPusUfscggUfgCfAfgcggCfuCfcucagscsc | 4285 | GGCUGAGGAGCCGCUGCACCGAC | 4330 |
| AD-1255842.1 | gsusggc(Uhd)GfaGfGfAfgccgcugcaaL96 | 4241 | VPusUfsgcaGfcGfGfcuccUfcAfgccacsasg | 4286 | CUGUGGCUGAGGAGCCGCUGCAC | 4331 |
| AD-1255826.1 | gsgscac(Ahd)GfcCfGfCfugcugccucaL96 | 4242 | VPusGfsaggCfaGfCfagcgGfcUfgugccsusg | 4287 | CAGGCACAGCCGCUGCUGCCUCA | 4332 |
| AD-1255828.1 | csascag(Chd)CfgCfUfGfcugccucagaL96 | 4243 | VPusCfsugaGfgCfAfgcagCfgGfcugugscsc | 4288 | GGCACAGCCGCUGCUGCCUCAGC | 4333 |
| AD-1255844.1 | gsgscug(Ahd)GfgAfGfCfcgcugcaccaL96 | 4244 | VPusGfsgugCfaGfCfggcuCfcUfcagccsasc | 4289 | GUGGCUGAGGAGCCGCUGCACCG | 4334 |
| AD-1289792.1 | csusucc(Uhd)CfaGfCfCfgccgccgcaaL96 | 4245 | VPusUfsgcgGfcGfGfcggcUfgAfggaagscsu | 4290 | AGCUUCCUCAGCCGCCGCCGCAG | 4335 |
| AD-1255825.1 | asgsgca(Chd)AfgCfCfGfcugcugccuaL96 | 4246 | VPusAfsggcAfgCfAfgcggCfuGfugccusgsc | 4291 | GCAGGCACAGCCGCUGCUGCCUC | 4336 |
| AD-1255822.1 | cscsgca(Ghd)GfcAfCfAfgccgcugcuaL96 | 4247 | VPusAfsgcaGfcGfGfcuguGfcCfugcggscsg | 4292 | CGCCGCAGGCACAGCCGCUGCUG | 4337 |
| AD-1255839.1 | gscsugu(Ghd)GfcUfGfAfggagccgcuaL96 | 4248 | VPusAfsgcgGfcUfCfcucaGfcCfacagcscsg | 4293 | CGGCUGUGGCUGAGGAGCCGCUG | 4338 |
| AD-1255827.1 | gscsaca(Ghd)CfcGfCfUfgcugccucaaL96 | 4249 | VPusUfsgagGfcAfGfcagcGfgCfugugcscsu | 4294 | AGGCACAGCCGCUGCUGCCUCAG | 4339 |

TABLE 29-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-1255824.1 | gscsagg(Chd)AfcAfGfCfcgcugcugcaL96 | 4250 | VPusGfscagCfaGfCfggcuGfuGfccugcsgsg | 4295 | CCGCAGGCACAGCCGCUGCUGCC | 4340 |
| AD-1255845.1 | gscsuga(Ghd)GfaGfCfCfgcugcaccgaL96 | 4251 | VPusCfsgguGfcAfGfcggcUfcCfucagcscsa | 4296 | UGGCUGAGGAGCCGCUGCACCGA | 4341 |
| AD-1255830.1 | cscsgcu(Ghd)CfuGfCfCfucagccgcaaL96 | 4252 | VPusUfsgcgGfcUfGfaggcAfgCfagcggscsu | 4297 | AGCCGCUGCUGCCUCAGCCGCAG | 4342 |
| AD-1289806.1 | gscscgc(Ahd)GfgCfAfCfagccgcugcaL96 | 4253 | VPusGfscagCfgGfCfugugCfcUfgcggcsgsg | 4298 | CCGCCGCAGGCACAGCCGCUGCU | 4343 |
| AD-1255836.1 | cscsggc(Uhd)GfuGfGfCfugaggagccaL96 | 4254 | VPusGfsgcuCfcUfCfagccAfcAfgccggsgsc | 4299 | GCCCGGCUGUGGCUGAGGAGCCG | 4344 |
| AD-1289807.1 | csasggc(Ahd)CfaGfCfCfgcugcugccaL96 | 4255 | VPusGfsgcaGfcAfGfcggcUfgUfgccugscsg | 4300 | CGCAGGCACAGCCGCUGCUGCCU | 4345 |
| AD-1289805.1 | csgsccg(Chd)AfgGfCfAfcagccgcugaL96 | 4256 | VPusCfsagcGfgCfUfgugcCfuGfcggcgsgsc | 4301 | GCCGCCGCAGGCACAGCCGCUGC | 4346 |
| AD-1255840.1 | csusgug(Ghd)CfuGfAfGfgagccgcugaL96 | 4257 | VPusCfsagcGfgCfUfccucAfgCfcacagscsc | 4302 | GGCUGUGGCUGAGGAGCCGCUGC | 4347 |
| AD-1289808.1 | csasgcc(Ghd)CfuGfCfUfgccucagccaL96 | 4258 | VPusGfsgcuGfaGfGfcagcAfgCfggcugsusg | 4303 | CACAGCCGCUGCUGCCUCAGCCG | 4348 |
| AD-1289800.1 | gscscgc(Chd)GfcCfGfCfaggcacagcaL96 | 4259 | VPusGfscugUfgCfCfugcgGfcGfgcggcsusg | 4304 | CAGCCGCCGCCGCAGGCACAGCC | 4349 |
| AD-1255838.1 | gsgscug(Uhd)GfgCfUfGfaggagccgcaL96 | 4260 | VPusGfscggCfuCfCfucagCfcAfcagccsgsg | 4305 | CCGGCUGUGGCUGAGGAGCCGCU | 4350 |
| AD-1255843.1 | usgsgcu(Ghd)AfgGfAfGfccgcugcacaL96 | 4261 | VPusGfsugcAfgCfGfgcucCfuCfagccascsa | 4306 | UGUGGCUGAGGAGCCGCUGCACC | 4351 |
| AD-1255837.1 | csgsgcu(Ghd)UfgGfCfUfgaggagccgaL96 | 4262 | VPusCfsggcUfcCfUfcagcCfaCfagccgsgsg | 4307 | CCCGGCUGUGGCUGAGGAGCCGC | 4352 |
| AD-1255833.1 | gsgsccc(Ghd)GfcUfGfUfggcugaggaaL96 | 4263 | VPusUfsccuCfaGfCfcacaGfcCfgggccsgsg | 4308 | CCGGCCCGGCUGUGGCUGAGGAG | 4353 |
| AD-1289797.1 | uscsagc(Chd)GfcCfGfCfcgcaggcacaL96 | 4264 | VPusGfsugcCfuGfCfggcgGfcGfgcugasgsg | 4309 | CCUCAGCCGCCGCCGCAGGCACA | 4354 |
| AD-1255823.1 | csgscag(Ghd)CfaCfAfGfccgcugcugaL96 | 4265 | VPusCfsagcAfgCfGfgcugUfgCfcugcgsgsc | 4310 | GCCGCAGGCACAGCCGCUGCUGC | 4355 |
| AD-1289810.1 | gscscgc(Uhd)GfcUfGfCfcucagccgcaL96 | 4266 | VPusGfscggCfuGfAfggcaGfcAfgcggcsusg | 4311 | CAGCCGCUGCUGCCUCAGCCGCA | 4356 |
| AD-1289811.1 | cscsggc(Chd)CfgGfCfUfguggcugagaL96 | 4267 | VPusCfsucaGfcCfAfcagcCfgGfgccggsgsu | 4312 | ACCCGGCCCGGCUGUGGCUGAGG | 4357 |
| AD-1289812.1 | csgsgcc(Chd)GfgCfUfGfugCfugaggaL96 | 4268 | VPusCfscucAfgCfCfacagCfcGfggccgsgsg | 4313 | CCCGGCCCGGCUGUGGCUGAGGA | 4358 |
| AD-1255841.1 | usgsugg(Chd)UfgAfGfGfagccgcugcaL96 | 4269 | VPusGfscagCfgGfCfuccuCfaGfccacasgsc | 4314 | GCUGUGGCUGAGGAGCCGCUGCA | 4359 |
| AD-1289799.1 | asgsccg(Chd)CfgCfCfGfcaggcacagaL96 | 4270 | VPusCfsuguGfcCfUfgcggCfgGfcggcusgsa | 4315 | UCAGCCGCCGCCGCAGGCACAGC | 4360 |
| AD-1255834.1 | gscsccg(Ghd)CfuGfUfGfgcugaggagaL96 | 4271 | VPusCfsuccUfcAfGfccacAfgCfcgggcscsg | 4316 | CGGCCCGGCUGUGGCUGAGGAGC | 4361 |
| AD-1289809.1 | asgsccg(Chd)UfgCfUfGfccucagccgaL96 | 4272 | VPusCfsggcUfgAfGfgcagCfaGfcggcusgsu | 4317 | ACAGCCGCUGCUGCCUCAGCCGC | 4362 |
| AD-1289801.1 | cscsgcc(Ghd)CfcGfCfAfggcacagccaL96 | 4273 | VPusGfsgcuGfuGfCfcugcGfgCfggcggscsu | 4318 | AGCCGCCGCCGCAGGCACAGCCG | 4363 |
| AD-1289793.1 | ususccu(Chd)AfgCfCfGfccgccgcagaL96 | 4274 | VPusCfsugcGfgCfGfgcggCfuGfaggaasgsc | 4319 | GCUUCCUCAGCCGCCGCCGCAGG | 4364 |

TABLE 29-continued

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1289798.1 | csasgcc(Ghd)CfcGfCfCfgcaggcacaaL96 | 4275 | VPusUfsgugCfcUfGfcggcGfgCfggcugsasg | 4320 | CUCAGCCGCCGCCGCAGGCACAG | 4365 |
| AD-1289796.1 | csuscag(Chd)CfgCfCfGfccgcaggcaaL96 | 4276 | VPusUfsgccUfgCfGfgcggCfgGfcugagsgsa | 4321 | UCCUCAGCCGCCGCCGCAGGCAC | 4366 |
| AD-1289803.1 | gscscgc(Chd)GfcAfGfGfcacagccgcaL96 | 4277 | VPusGfscggCfuGfUfgccuGfcGfgcggcsgsg | 4322 | CCGCCGCCGCAGGCACAGCCGCU | 4367 |
| AD-1255835.1 | cscscgg(Chd)UfgUfGfGfcugaggagcaL96 | 4278 | VPusGfscucCfuCfAfgccaCfaGfccgggscsc | 4323 | GGCCCGGCUGUGGCUGAGGAGCC | 4368 |
| AD-1289802.1 | csgsccg(Chd)CfgCfAfGfgcacagccgaL96 | 4279 | VPusCfsggcUfgUfGfccugCfgGfcggcgsgsc | 4324 | GCCGCCGCCGCAGGCACAGCCGC | 4369 |
| AD-1289794.1 | uscscuc(Ahd)GfcCfGfCfcgccgcaggaL96 | 4280 | VPusCfscugCfgGfCfggcgGfcUfgaggasasg | 4325 | CUUCCUCAGCCGCCGCCGCAGGC | 4370 |
| AD-1289795.1 | cscsuca(Ghd)CfcGfCfCfgccgcaggcaL96 | 4281 | VPusGfsccuGfcGfGfcggcGfgCfugaggsasa | 4326 | UUCCUCAGCCGCCGCCGCAGGCA | 4371 |

TABLE 30

Unmodified Sense and Antisense Strand Sequences of Huntingtin (HTT) dsRNA Agents

| Duplex Name | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-1255829.1 | ACAGCCGCUGCUGCCUCAGCA | 4372 | 325-345 | UGCUGAGGCAGCAGCGGCUGUGC | 4417 | 323-345 |
| AD-1289804.1 | CCGCCGCAGGCACAGCCGCUA | 4373 | 314-334 | UAGCGGCUGUGCCUGCGGCGGCG | 4418 | 312-334 |
| AD-1255847.1 | UGAGGAGCCGCUGCACCGACA | 4374 | 394-414 | UGUCGGUGCAGCGGCUCCUCAGC | 4419 | 392-414 |
| AD-1255846.1 | CUGAGGAGCCGCUGCACCGAA | 4375 | 393-413 | UUCGGUGCAGCGGCUCCUCAGCC | 4420 | 391-413 |
| AD-1255842.1 | GUGGCUGAGGAGCCGCUGCAA | 4376 | 389-409 | UUGCAGCGGCUCCUCAGCCACAG | 4421 | 387-409 |
| AD-1255826.1 | GGCACAGCCGCUGCUGCCUCA | 4377 | 322-342 | UGAGGCAGCAGCGGCUGUGCCUG | 4422 | 320-342 |
| AD-1255828.1 | CACAGCCGCUGCUGCCUCAGA | 4378 | 324-344 | UCUGAGGCAGCAGCGGCUGUGCC | 4423 | 322-344 |
| AD-1255844.1 | GGCUGAGGAGCCGCUGCACCA | 4379 | 391-411 | UGGUGCAGCGGCUCCUCAGCCAC | 4424 | 389-411 |
| AD-1289792.1 | CUUCCUCAGCCGCCGCCGCAA | 4380 | 302-322 | UUGCGGCGGCGGCUGAGGAAGCU | 4425 | 300-322 |
| AD-1255825.1 | AGGCACAGCCGCUGCUGCCUA | 4381 | 321-341 | UAGGCAGCAGCGGCUGUGCCUGC | 4426 | 319-341 |
| AD-1255822.1 | CCGCAGGCACAGCCGCUGCUA | 4382 | 317-337 | UAGCAGCGGCUGUGCCUGCGGCG | 4427 | 315-337 |
| AD-1255839.1 | GCUGUGGCUGAGGAGCCGCUA | 4383 | 386-406 | UAGCGGCUCCUCAGCCACAGCCG | 4428 | 384-406 |
| AD-1255827.1 | GCACAGCCGCUGCUGCCUCAA | 4384 | 323-343 | UUGAGGCAGCAGCGGCUGUGCCU | 4429 | 321-343 |
| AD-1255824.1 | GCAGGCACAGCCGCUGCUGCA | 4385 | 319-339 | UGCAGCAGCGGCUGUGCCUGCGG | 4430 | 317-339 |
| AD-1255845.1 | GCUGAGGAGCCGCUGCACCGA | 4386 | 392-412 | UCGGUGCAGCGGCUCCUCAGCCA | 4431 | 390-412 |
| AD-1255830.1 | CCGCUGCUGCCUCAGCCGCAA | 4387 | 329-349 | UUGCGGCUGAGGCAGCAGCGGCU | 4432 | 327-349 |
| AD-1289806.1 | GCCGCAGGCACAGCCGCUGCA | 4388 | 316-336 | UGCAGCGGCUGUGCCUGCGGCGG | 4433 | 314-336 |
| AD-1255836.1 | CCGGCUGUGGCUGAGGAGCCA | 4389 | 383-403 | UGGCUCCUCAGCCACAGCCGGGC | 4434 | 381-403 |
| AD-1289807.1 | CAGGCACAGCCGCUGCUGCCA | 4390 | 320-340 | UGGCAGCAGCGGCUGUGCCUGCG | 4435 | 318-340 |
| AD-1289805.1 | CGCCGCAGGCACAGCCGCUGA | 4391 | 315-335 | UCAGCGGCUGUGCCUGCGGCGGC | 4436 | 313-335 |
| AD-1255840.1 | CUGUGGCUGAGGAGCCGCUGA | 4392 | 387-407 | UCAGCGGCUCCUCAGCCACAGCC | 4437 | 385-407 |

TABLE 30-continued

Unmodified Sense and Antisense Strand Sequences of Huntingtin (HTT) dsRNA Agents

| Duplex Name | Sense Sequence 5' to 3' | SEQ ID NO: | Range in NM_002111.8 | Antisense Sequence 5' to 3' | SEQ ID NO: | Range in NM_002111.8 |
|---|---|---|---|---|---|---|
| AD-1289808.1 | CAGCCGCUGCUGCCUCAGCCA | 4393 | 326-346 | UGGCUGAGGCAGCAGCGGCUGUG | 4438 | 324-346 |
| AD-1289800.1 | GCCGCCGCCGCAGGCACAGCA | 4394 | 310-330 | UGCUGUGCCUGCGGCGGCGGCUG | 4439 | 308-330 |
| AD-1255838.1 | GGCUGUGGCUGAGGAGCCGCA | 4395 | 385-405 | UGCGGCUCCUCAGCCACAGCCGG | 4440 | 383-405 |
| AD-1255843.1 | UGGCUGAGGAGCCGCUGCACA | 4396 | 390-410 | UGUGCAGCGGCUCCUCAGCCACA | 4441 | 388-410 |
| AD-1255837.1 | CGGCUGUGGCUGAGGAGCCGA | 4397 | 384-404 | UCGGCUCCUCAGCCACAGCCGGG | 4442 | 382-404 |
| AD-1255833.1 | GGCCCGGCUGUGGCUGAGGAA | 4398 | 380-400 | UUCCUCAGCCACAGCCGGGCCGG | 4443 | 378-400 |
| AD-1289797.1 | UCAGCCGCCGCCGCAGGCACA | 4399 | 307-327 | UGUGCCUGCGGCGGCGGCUGAGG | 4444 | 305-327 |
| AD-1255823.1 | CGCAGGCACAGCCGCUGCUGA | 4400 | 318-338 | UCAGCAGCGGCUGUGCCUGCGGC | 4445 | 316-338 |
| AD-1289810.1 | GCCGCUGCUGCCUCAGCCGCA | 4401 | 328-348 | UGCGGCUGAGGCAGCAGCGGCUG | 4446 | 326-348 |
| AD-1289811.1 | CCGGCCCGGCUGUGGCUGAGA | 4402 | 378-398 | UCUCAGCCACAGCCGGGCCGGGU | 4447 | 376-398 |
| AD-1289812.1 | CGGCCCGGCUGUGGCUGAGGA | 4403 | 379-399 | UCCUCAGCCACAGCCGGGCCGGG | 4448 | 377-399 |
| AD-1255841.1 | UGUGGCUGAGGAGCCGCUGCA | 4404 | 388-408 | UGCAGCGGCUCCUCAGCCACAGC | 4449 | 386-408 |
| AD-1289799.1 | AGCCGCCGCCGCAGGCACAGA | 4405 | 309-329 | UCUGUGCCUGCGGCGGCGGCUGA | 4450 | 307-329 |
| AD-1255834.1 | GCCCGGCUGUGGCUGAGGAGA | 4406 | 381-401 | UCUCCUCAGCCACAGCCGGGCCG | 4451 | 379-401 |
| AD-1289809.1 | AGCCGCUGCUGCCUCAGCCGA | 4407 | 327-347 | UCGGCUGAGGCAGCAGCGGCUGU | 4452 | 325-347 |
| AD-1289801.1 | CCGCCGCCGCAGGCACAGCCA | 4408 | 311-331 | UGGCUGUGCCUGCGGCGGCGGCU | 4453 | 309-331 |
| AD-1289793.1 | UUCCUCAGCCGCCGCCGCAGA | 4409 | 303-323 | UCUGCGGCGGCGGCUGAGGAAGC | 4454 | 301-323 |
| AD-1289798.1 | CAGCCGCCGCCGCAGGCACAA | 4410 | 308-328 | UUGUGCCUGCGGCGGCGGCUGAG | 4455 | 306-328 |
| AD-1289796.1 | CUCAGCCGCCGCCGCAGGCAA | 4411 | 306-326 | UUGCCUGCGGCGGCGGCUGAGGA | 4456 | 304-326 |
| AD-1289803.1 | GCCGCCGCAGGCACAGCCGCA | 4412 | 313-333 | UGCGGCUGUGCCUGCGGCGGCGG | 4457 | 311-333 |
| AD-1255835.1 | CCCGGCUGUGGCUGAGGAGCA | 4413 | 382-402 | UGCUCCUCAGCCACAGCCGGGCC | 4458 | 380-402 |
| AD-1289802.1 | CGCCGCCGCAGGCACAGCCGA | 4414 | 312-332 | UCGGCUGUGCCUGCGGCGGCGGC | 4459 | 310-332 |
| AD-1289794.1 | UCCUCAGCCGCCGCCGCAGGA | 4415 | 304-324 | UCCUGCGGCGGCGGCUGAGGAAG | 4460 | 302-324 |
| AD-1289795.1 | CCUCAGCCGCCGCCGCAGGCA | 4416 | 305-325 | UGCCUGCGGCGGCGGCUGAGGAA | 4461 | 303-325 |

TABLE 32

Modified Sense and Antisense Strand Sequences of Huntingtin (HTT) dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1107441 | ascsggc(Chd)GfcUfCfAfgg uucugcuaL96 | 3636 | VPusAfsgcaGfaAfCfcugaGfcGfg ccguscsc | 3655 | GGACGGCCGCUCAGGUU CUGCUU | 3742 |
| AD-1107446 | cscsaga(Ghd)CfcCfCfAfuu cauugccaL96 | 3609 | VPusGfsgcaAfuGfAfauggGfgCfu cuggsgsc | 3661 | GCCCAGAGCCCCAUUCA UUGCCC | 3747 |
| AD-1107445 | csuscag(Ghd)UfuCfUfGfcu uuuaccuaL96 | 3584 | VPusAfsgguAfaAfAfgcagAfaCfc ugagscsg | 3645 | CGCUCAGGUUCUGCUUU UACCUG | 3732 |
| AD-1107440 | gsgsacg(Ghd)CfcGfCfUfca gguucugaL96 | 3613 | VPusCfsagaAfcCfUfgagcGfgCfc guccsasu | 3673 | AUGGACGGCCGCUCAGG UUCUGC | 3754 |
| AD-1107444 | gscsuca(Ghd)GfuUfCfUfgc uuuuaccaL96 | 3572 | VPusGfsguaAfaAfGfcagaAfcCfu gagcsgsg | 3665 | CCGCUCAGGUUCUGCUU UUACCU | 3745 |

TABLE 32-continued

| Modified Sense and Antisense Strand Sequences of Huntingtin (HTT) dsRNA Agents | | | | | | |
|---|---|---|---|---|---|---|
| Duplex ID | Sense Sequence 5' to 3' | SEQ ID NO: | Antisense Sequence 5' to 3' | SEQ ID NO: | mRNA Target Sequence 5' to 3' | SEQ ID NO: |
| AD-1107443 | csgscuc(Ahd)GfgUfUfCfug cuuuuacaL96 | 3576 | VPusGfsuaaAfaGfCfagaaCfcUfg agcgsgsc | 3649 | GCCGCUCAGGUUCUGCU UUUACC | 3736 |
| AD-1107450 | csusgau(Ghd)AfaGfGfCfcu ucgagucaL96 | 3563 | VPusGfsacuCfgAfAfggccUfuCfa ucagscsu | 3993 | AGCUGAUGAAGGCCUUC GAGUCC | 3737 |
| AD-1107452 | cscsuuc(Ghd)AfgUfCfCfcu caaguccaL96 | 3567 | VPusGfsgacUfuGfAfgggaCfuCfg aaggscsc | 4001 | GGCCUUCGAGUCCCUCA AGUCCU | 3741 |
| AD-1107454 | gsusccc(Uhd)CfaAfGfUfcc uuccagcaL96 | 3620 | VPusGfscugGfaAfGfgacuUfgAfg ggacsusc | 4007 | GAGUCCCUCAAGUCCUU CCAGCA | 3782 |
| AD-1107453 | ususcga(Ghd)UfcCfCfUfca aguccuuaL96 | 3598 | VPusAfsaggAfcUfUfgaggGfaCfu cgaasgsg | 4003 | CCUUCGAGUCCCUCAAG UCCUUC | 3765 |
| AD-1107439 | usgsgac(Ghd)GfcCfGfCfuc agguucuaL96 | 3592 | VPusAfsgaaCfcUfGfagcgGfcCfg uccasusc | 3675 | GAUGGACGGCCGCUCAG GUUCUG | 3756 |
| AD-1107448 | asusggc(Ghd)AfcCfCfUfgg aaaagcuaL96 | 3596 | VPusAfsgcuUfuUfCfcaggGfuCfg ccausgsg | 3983 | CCAUGGCGACCCUGGAA AAGCUG | 3763 |
| AD-1289840 | csusga(Uhd)gAfaGfGfCfcu ucgagucaL96 | 4462 | VPusdGsacdTc(G2p)aaggccUfuC faucagscsu | 4470 | AGCUGAUGAAGGCCUUC GAGUCC | 3737 |
| AD-1289848 | csusga(Ahd)gAfaGfGfCfcu ucgagucaL96 | 4463 | VPusdGsacdTc(G2p)aaggccUfuC fuucagscsu | 4471 | AGCUGAUGAAGGCCUUC GAGUCC | 3737 |
| AD-1210232 | gsasccc(Uhd)GfgAfAfAfag cugaugaaL96 | 3593 | VPusUfscauCfaGfCfuuuuCfcAfg ggucsgsc | 3987 | GCGACCCUGGAAAAGCU GAUGAA | 3760 |
| AD-1210237 | usgsgaa(Ahd)AfgCfUfGfau gaaggccaL96 | 3566 | VPusGfsgccUfuCfAfucagCfuUfu uccasgsg | 3990 | CCUGGAAAAGCUGAUGA AGGCCU | 3740 |
| AD-1210241 | asasagc(Uhd)GfaUfGfAfag gccuucgaL96 | 3560 | VPusCfsgaaGfgCfCfuucaUfcAfg cuuususc | 3991 | GAAAAGCUGAUGAAGGC CUUCGA | 3734 |
| AD-1210242 | usgsaug(Ahd)AfgGfCfCfuu cgaguccaL96 | 3587 | VPusGfsgacUfcGfAfaggcCfuUfc aucasgsc | 3994 | GCUGAUGAAGGCCUUCG AGUCCC | 3755 |
| AD-1210244 | gsgsccu(Uhd)CfgAfGfUfcc cucaaguaL96 | 3614 | VPusAfscuuGfaGfGfgacuCfgAfa ggccsusu | 3999 | AAGGCCUUCGAGUCCCU CAAGUC | 3777 |
| AD-1210245 | csusucg(Ahd)GfuCfCfCfuc aaguccuaL96 | 3581 | VPusAfsggaCfuUfGfagggAfcUfc gaagsgsc | 4002 | GCCUUCGAGUCCCUCAA GUCCUU | 3751 |
| AD-1210247 | gsasguc(Chd)CfuCfAfAfgu ccuuccaaL96 | 3582 | VPusUfsggaAfgGfAfcuugAfgGfg acucsgsa | 4006 | UCGAGUCCCUCAAGUCC UUCCAG | 3752 |
| AD-1289816 | gscsucagguUfCfUfgcuu (Uhd)uaccaL96 | 4464 | VPusdGsgudAa(Agn)agcagaAfcC fugagcsgsg | 4472 | CCGCUCAGGUUCUGCUU UUACCU | 3745 |
| AD-1289819 | uscsagguUfCfUfgcuu(Uhd) uaccaL96 | 4465 | VPusdGsgudAa(A2p)agcagaAfcC fugasgsc | 4473 | GCUCAGGUUCUGCUUUU ACCU | 4479 |
| AD-1289886 | csuscaggUfuCfUfGfcuuu (Uhd)accuaL96 | 4466 | VPusAfsggdTa(Agn)aagcagAfaC fcugagscsg | 4474 | CGCUCAGGUUCUGCUUU UACCUG | 3732 |
| AD-1289906 | uscsg(Ahd)guCfCfCfucaag uccuaL96 | 4467 | VPusAfsggdAc(Tgn)ugagggAfcU fcgasgsg | 4475 | CUUCGAGUCCCUCAAGU CCUU | 4480 |
| AD-1289907 | uscsg(Ahd)guCfCfCfucaag uccuaL96 | 4467 | VPusAfsggdAc(U2p)ugagggAfcU fcgasusc | 4476 | CUUCGAGUCCCUCAAGU CCUU | 4480 |
| AD-1289909 | csusugg(Ahd)guCfCfCfuca aguccuaL96 | 4468 | VPusAfsggdAc(U2p)ugagggAfcU fccaagsgsc | 4477 | GCCUUCGAGUCCCUCAA GUCCUU | 3751 |
| AD-1289964 | gscscgc(Uhd)CfadGgUfucu gcuuuuaL96 | 4469 | VPusAfsaadAg(C2p)agaadCcUfg Afgcggcscsg | 4478 | CGGCCGCUCAGGUUCUG CUUUUA | 3733 |

TABLE 33

| Unmodified Sense and Antisense Strand Sequences of Huntingtin (HTT) dsRNA Agents | | | | | | |
|---|---|---|---|---|---|---|
| Duplex Name | Sense Sequence 5' to 3' | SEQ ID NO: | Range in NM_002111.8 | Antisense Sequence 5' to 3' | SEQ ID NO: | Range in NM_002111.8 |
| AD-1107441 | ACGGCCGCUCAGGUUCUGCUA | 3807 | 25-45 | UAGCAGAACCUGAGCGGCCGUCC | 3872 | 23-45 |
| AD-1107446 | CCAGAGCCCCAUUCAUUGCCA | 3812 | 57-77 | UGGCAAUGAAUGGGGCUCUGGGC | 3877 | 55-77 |
| AD-1107445 | CUCAGGUUCUGCUUUUACCUA | 3797 | 32-52 | UAGGUAAAAGCAGAACCUGAGCG | 3862 | 30-52 |
| AD-1107440 | GGACGGCCGCUCAGGUUCUGA | 3819 | 23-43 | UCAGAACCUGAGCGGCCGUCCAU | 3885 | 21-43 |
| AD-1107444 | GCUCAGGUUCUGCUUUUACCA | 3810 | 31-51 | UGGUAAAAGCAGAACCUGAGCGG | 3875 | 29-51 |
| AD-1107443 | CGCUCAGGUUCUGCUUUUACA | 3801 | 30-50 | UGUAAAAGCAGAACCUGAGCGGC | 3866 | 28-50 |
| AD-1107450 | CUGAUGAAGGCCUUCGAGUCA | 3802 | 164-184 | UGACUCGAAGGCCUUCAUCAGCU | 3867 | 162-184 |
| AD-1107452 | CCUUCGAGUCCCUCAAGUCCA | 3806 | 174-194 | UGGACUUGAGGGACUCGAAGGCC | 4017 | 172-194 |
| AD-1107454 | GUCCCUCAAGUCCUUCCAGCA | 3847 | 181-201 | UGCUGGAAGGACUUGAGGGACUC | 3914 | 179-201 |
| AD-1107453 | UUCGAGUCCCUCAAGUCCUUA | 3830 | 176-196 | UAAGGACUUGAGGGACUCGAAGG | 3896 | 174-196 |
| AD-1107439 | UGGACGGCCGCUCAGGUUCUA | 3821 | 22-42 | UAGAACCUGAGCGGCCGUCCAUC | 3887 | 20-42 |
| AD-1107448 | AUGGCGACCCUGGAAAAGCUA | 3828 | 146-166 | UAGCUUUUCCAGGGUCGCCAUGG | 4013 | 144-166 |
| AD-1289840 | CUGAUGAAGGCCUUCGAGUCA | 3802 | 164-184 | UGACTCGAAGGCCUUCAUCAGCU | 4485 | 162-184 |
| AD-1289848 | CUGAAGAAGGCCUUCGAGUCA | 4481 | 164-184 | UGACTCGAAGGCCUUCUUCAGCU | 4486 | 162-184 |
| AD-1210232 | GACCCUGGAAAAGCUGAUGAA | 3825 | 151-171 | UUCAUCAGCUUUUCCAGGGUCGC | 3891 | 149-171 |
| AD-1210237 | UGGAAAAGCUGAUGAAGGCCA | 3805 | 156-176 | UGGCCUUCAUCAGCUUUUCCAGG | 4015 | 154-176 |
| AD-1210241 | AAAGCUGAUGAAGGCCUUCGA | 3799 | 160-180 | UCGAAGGCCUUCAUCAGCUUUUC | 3864 | 158-180 |
| AD-1210242 | UGAUGAAGGCCUUCGAGUCCA | 3820 | 165-185 | UGGACUCGAAGGCCUUCAUCAGC | 3886 | 163-185 |
| AD-1210244 | GGCCUUCGAGUCCCUCAAGUA | 3842 | 172-192 | UACUUGAGGGACUCGAAGGCCUU | 3909 | 170-192 |
| AD-1210245 | CUUCGAGUCCCUCAAGUCCUA | 3816 | 175-195 | UAGGACUUGAGGGACUCGAAGGC | 4018 | 173-195 |
| AD-1210247 | GAGUCCCUCAAGUCCUUCCAA | 3817 | 179-199 | UUGGAAGGACUUGAGGGACUCGA | 3883 | 177-199 |
| AD-1289816 | GCUCAGGUUCUGCUUUUACCA | 3810 | 31-51 | UGGUAAAAGCAGAACCUGAGCGG | 3875 | 29-51 |
| AD-1289819 | UCAGGUUCUGCUUUUACCA | 4482 | 33-51 | UGGUAAAAGCAGAACCUGAGC | 4487 | 31-51 |
| AD-1289886 | CUCAGGUUCUGCUUUUACCUA | 3797 | 32-52 | UAGGTAAAAGCAGAACCUGAGCG | 4488 | 30-52 |
| AD-1289906 | UCGAGUCCCUCAAGUCCUA | 4483 | 177-195 | UAGGACTUGAGGGACUCGAGG | 4489 | 175-195 |
| AD-1289907 | UCGAGUCCCUCAAGUCCUA | 4483 | 177-195 | UAGGACUUGAGGGACUCGAUC | 4490 | 175-195 |
| AD-1289909 | CUUGGAGUCCCUCAAGUCCUA | 4484 | 175-195 | UAGGACUUGAGGGACUCGAAGGC | 4491 | 173-195 |
| AD-1289964 | GCCGCUCAGGUUCUGCUUUUA | 3798 | 28-48 | UAAAAGCAGAACCUGAGCGGCCG | 3863 | 26-48 |

TABLE 4

| HTT Single Dose Screens in BE(2)C Cells | | | | |
|---|---|---|---|---|
| | 10 nM Dose | | 0.1 nM Dose | |
| Duplex | Avg % HTT mRNA Remaining | SD | Avg % HTT mRNA Remaining | SD |
| AD-384118.1 | 51.69 | 25.40 | 46.89 | 7.33 |
| AD-380543.1 | 95.92 | 27.12 | 71.60 | 24.68 |
| AD-380533.1 | 105.39 | 28.38 | 91.67 | 26.80 |
| AD-384038.1 | 154.15 | 20.25 | 125.43 | 25.19 |
| AD-380805.1 | 101.15 | 19.55 | 114.28 | 15.36 |

TABLE 4-continued

| HTT Single Dose Screens in BE(2)C Cells | | | | |
|---|---|---|---|---|
| | 10 nM Dose | | 0.1 nM Dose | |
| Duplex | Avg % HTT mRNA Remaining | SD | Avg % HTT mRNA Remaining | SD |
| AD-380117.1 | 130.05 | 21.16 | 122.25 | 14.15 |
| AD-381341.1 | 138.31 | 25.62 | 146.74 | 39.17 |
| AD-379426.1 | 145.46 | 25.51 | 151.86 | 38.36 |
| AD-380888.1 | 130.28 | 16.92 | 134.28 | 21.73 |
| AD-384841.1 | 125.51 | 34.07 | 115.98 | 15.20 |

TABLE 4-continued

| HTT Single Dose Screens in BE(2)C Cells | | | | |
|---|---|---|---|---|
| | 10 nM Dose | | 0.1 nM Dose | |
| Duplex | Avg % HTT mRNA Remaining | SD | Avg % HTT mRNA Remaining | SD |
| AD-380853.1 | 107.44 | 23.39 | 98.68 | 4.67 |
| AD-379602.1 | 84.02 | 18.25 | 172.53 | 35.05 |
| AD-382484.1 | 75.19 | 25.05 | 57.22 | 13.43 |
| AD-380741.1 | 118.53 | 24.70 | 73.00 | 3.77 |
| AD-380534.1 | 143.75 | 30.13 | 103.24 | 23.54 |
| AD-384053.1 | 87.87 | 16.27 | 130.20 | 13.77 |
| AD-380916.1 | 95.50 | 29.09 | 144.05 | 13.23 |
| AD-380402.1 | 139.27 | 15.07 | 126.43 | 16.30 |
| AD-381464.1 | 135.36 | 39.85 | 134.37 | 31.20 |
| AD-379729.1 | 84.36 | 24.54 | 137.33 | 26.49 |
| AD-381065.1 | 141.96 | 30.56 | 136.29 | 12.84 |
| AD-379466.1 | 115.44 | 40.22 | 120.93 | 21.48 |
| AD-380885.1 | 95.86 | 10.93 | 139.28 | 22.72 |
| AD-379897.1 | 95.59 | 22.26 | 172.12 | 33.52 |
| AD-381124.1 | 59.94 | 26.80 | 51.93 | 10.57 |
| AD-380807.1 | 99.61 | 30.47 | 77.87 | 21.23 |
| AD-380806.1 | 132.18 | 39.93 | 102.86 | 19.45 |
| AD-384843.1 | 117.21 | 24.86 | 123.71 | 11.78 |
| AD-381257.1 | 99.30 | 30.21 | 124.74 | 10.99 |
| AD-380408.1 | 157.70 | 44.86 | 129.06 | 19.38 |
| AD-381570.1 | 193.38 | 37.37 | 125.32 | 13.13 |
| AD-380093.1 | 192.68 | 42.81 | 135.16 | 26.86 |
| AD-381148.1 | 187.13 | 28.75 | 137.42 | 11.82 |
| AD-379475.1 | 149.83 | 36.22 | 124.88 | 9.89 |
| AD-381142.1 | 131.62 | 40.12 | 121.85 | 12.50 |
| AD-380852.1 | 76.23 | 5.88 | 198.90 | 40.31 |
| AD-379935.1 | 64.90 | 29.25 | 53.70 | 13.77 |
| AD-381117.1 | 95.64 | 33.48 | 68.03 | 15.97 |
| AD-380808.1 | 124.46 | 39.75 | 95.85 | 8.44 |
| AD-379471.1 | 93.97 | 29.87 | 104.28 | 18.99 |
| AD-381342.1 | 107.50 | 20.99 | 126.66 | 32.01 |
| AD-380411.1 | 148.77 | 15.63 | 134.25 | 21.15 |
| AD-382487.1 | 155.26 | 47.54 | 136.80 | 13.12 |
| AD-380116.1 | 156.98 | 36.49 | 156.00 | 25.80 |
| AD-381150.1 | 149.99 | 39.15 | 135.76 | 22.27 |
| AD-379476.1 | 132.34 | 43.09 | 131.15 | 14.36 |
| AD-382444.1 | 122.07 | 26.37 | 118.65 | 22.02 |
| AD-380883.1 | 52.18 | 15.97 | 257.45 | 13.08 |
| AD-379941.1 | 59.35 | 31.34 | 58.84 | 13.25 |
| AD-381578.1 | 75.64 | 37.02 | 60.08 | 4.32 |
| AD-381460.1 | 101.15 | 24.87 | 96.09 | 11.60 |
| AD-379939.1 | 156.24 | 25.09 | 99.44 | 17.05 |
| AD-384039.1 | 127.13 | 42.92 | 108.45 | 32.25 |
| AD-380735.1 | 137.74 | 42.47 | 128.37 | 15.25 |
| AD-382525.1 | 154.67 | 44.65 | 124.68 | 26.66 |
| AD-380713.1 | 163.12 | 43.55 | 130.38 | 21.77 |
| AD-382149.1 | 135.62 | 22.90 | 139.99 | 28.87 |
| AD-379855.1 | 145.22 | 39.96 | 122.14 | 13.22 |
| AD-383508.1 | 135.52 | 24.12 | 118.15 | 5.12 |
| AD-381273.1 | 74.96 | 3.61 | 192.17 | 24.11 |
| AD-382483.1 | 51.15 | 24.35 | 67.84 | 17.97 |
| AD-382481.1 | 82.28 | 22.45 | 74.06 | 8.54 |
| AD-382485.1 | 100.70 | 33.99 | 90.08 | 11.68 |
| AD-380092.1 | 101.09 | 37.56 | 93.42 | 10.74 |
| AD-379420.1 | 102.06 | 37.49 | 99.35 | 10.17 |
| AD-380800.1 | 84.91 | 25.98 | 116.09 | 25.96 |
| AD-384030.1 | 143.57 | 39.66 | 115.50 | 24.98 |
| AD-380737.1 | 149.04 | 34.89 | 137.50 | 24.60 |
| AD-382780.1 | 155.32 | 21.47 | 145.73 | 18.80 |
| AD-379944.1 | 146.65 | 40.50 | 148.17 | 14.59 |
| AD-379461.1 | 134.09 | 14.71 | 129.84 | 8.09 |
| AD-381856.1 | 51.32 | 13.29 | 125.92 | 43.49 |
| AD-379418.1 | 23.32 | 9.32 | 37.51 | 6.01 |
| AD-382924.1 | 76.58 | 31.10 | 51.58 | 11.97 |
| AD-383759.1 | 88.53 | 29.71 | 73.95 | 12.45 |
| AD-380409.1 | 121.08 | 24.07 | 83.54 | 6.71 |
| AD-379380.1 | 33.65 | 6.37 | 100.25 | 16.79 |
| AD-381145.1 | 113.55 | 24.69 | 100.19 | 22.11 |
| AD-384054.1 | 113.24 | 20.54 | 116.75 | 20.01 |
| AD-380796.1 | 145.88 | 42.84 | 140.74 | 14.73 |
| AD-382960.1 | 145.68 | 37.86 | 138.28 | 27.41 |
| AD-380555.1 | 106.36 | 26.58 | 139.27 | 18.75 |

TABLE 4-continued

| HTT Single Dose Screens in BE(2)C Cells | | | | |
|---|---|---|---|---|
| | 10 nM Dose | | 0.1 nM Dose | |
| Duplex | Avg % HTT mRNA Remaining | SD | Avg % HTT mRNA Remaining | SD |
| AD-379462.1 | 158.82 | 47.01 | 119.08 | 13.60 |
| AD-382118.1 | 88.57 | 19.33 | 110.03 | 27.29 |
| AD-380414.1 | 37.65 | 8.76 | 33.69 | 1.29 |
| AD-380091.1 | 52.46 | 27.92 | 47.36 | 13.94 |
| AD-383761.1 | 51.55 | 19.45 | 61.12 | 13.37 |
| AD-380740.1 | 32.40 | 12.55 | 65.91 | 18.47 |
| AD-379945.1 | 47.84 | 25.04 | 94.57 | 15.24 |
| AD-379425.1 | 52.33 | 16.94 | 89.98 | 12.20 |
| AD-380886.1 | 111.81 | 24.52 | 137.52 | 37.78 |
| AD-384366.1 | 103.34 | 14.61 | 105.10 | 18.86 |
| AD-380798.1 | 109.34 | 31.61 | 103.41 | 21.42 |
| AD-379463.1 | 112.46 | 30.89 | 92.69 | 9.78 |
| AD-382148.1 | 40.89 | 7.63 | 59.31 | 20.48 |
| AD-357754.1 | 25.92 | 3.91 | 59.47 | 11.65 |
| AD-356938.1 | 19.38 | 3.74 | 66.11 | 22.41 |
| AD-355054.1 | 73.88 | 18.14 | 121.65 | 15.38 |
| AD-357748.1 | 58.16 | 15.88 | 122.16 | 5.44 |
| AD-355704.1 | 37.44 | 4.59 | 165.32 | 50.68 |
| AD-356946.1 | 48.39 | 8.85 | 162.43 | 42.24 |
| AD-353499.1 | 32.30 | 7.21 | 139.76 | 50.75 |
| AD-354076.1 | 88.26 | 13.12 | 133.42 | 42.69 |
| AD-356630.1 | 37.53 | 3.16 | 92.04 | 25.79 |
| AD-353351.1 | 41.71 | 6.98 | 96.78 | 14.30 |
| AD-359803.1 | 54.29 | 19.36 | 177.30 | 41.38 |
| AD-382526.1 | 38.58 | 7.17 | 54.67 | 10.40 |
| AD-356975.1 | 33.90 | 7.35 | 80.03 | 9.50 |
| AD-356974.1 | 32.22 | 5.95 | 120.19 | 17.90 |
| AD-355117.1 | 37.63 | 2.69 | 117.21 | 11.97 |
| AD-357755.1 | 104.49 | 8.71 | 136.50 | 16.63 |
| AD-356382.1 | 94.77 | 7.03 | 150.60 | 13.96 |
| AD-356973.1 | 85.49 | 7.63 | 148.93 | 18.16 |
| AD-358488.1 | 46.44 | 2.36 | 139.29 | 25.52 |
| AD-354078.1 | 46.34 | 5.84 | 129.77 | 43.58 |
| AD-356638.1 | 77.64 | 14.67 | 138.53 | 22.89 |
| AD-357096.1 | 48.16 | 2.44 | 135.84 | 19.68 |
| AD-361492.1 | 56.56 | 15.98 | 124.38 | 30.67 |
| AD-382775.1 | 42.95 | 11.66 | 76.60 | 16.23 |
| AD-357239.1 | 24.39 | 3.37 | 60.14 | 11.30 |
| AD-357756.1 | 78.94 | 10.48 | 109.26 | 30.70 |
| AD-356384.1 | 36.95 | 9.36 | 105.38 | 12.36 |
| AD-357879.1 | 42.50 | 4.51 | 117.99 | 20.11 |
| AD-356386.1 | 68.71 | 7.28 | 147.92 | 36.10 |
| AD-356995.1 | 60.22 | 5.01 | 168.66 | 25.76 |
| AD-353516.1 | 33.15 | 9.36 | 133.30 | 18.51 |
| AD-354079.1 | 49.35 | 5.31 | 130.79 | 14.08 |
| AD-356639.1 | 36.33 | 3.49 | 117.25 | 22.43 |
| AD-357649.1 | 85.70 | 2.07 | 91.78 | 58.01 |
| AD-361496.1 | 41.93 | 12.04 | 140.37 | 30.87 |
| AD-382777.1 | 56.23 | 13.88 | 58.04 | 19.93 |
| AD-353525.1 | 21.75 | 2.08 | 58.46 | 7.82 |
| AD-358480.1 | 26.74 | 5.28 | 64.94 | 13.24 |
| AD-356388.1 | 45.10 | 10.22 | 109.51 | 34.60 |
| AD-353500.1 | 40.43 | 3.34 | 102.99 | 14.32 |
| AD-356407.1 | 61.59 | 6.59 | 157.31 | 42.34 |
| AD-357068.1 | 45.70 | 7.82 | 160.84 | 46.87 |
| AD-359802.1 | 33.72 | 4.31 | 149.89 | 20.91 |
| AD-354638.1 | 65.21 | 2.80 | 170.34 | 27.30 |
| AD-356663.1 | 58.99 | 6.53 | 128.37 | 38.64 |
| AD-357651.1 | 88.23 | 17.45 | 107.54 | 38.79 |
| AD-362085.1 | 86.17 | 27.21 | 170.36 | 24.85 |
| AD-384329.1 | 61.30 | 6.83 | 52.87 | 3.24 |
| AD-354067.1 | 23.37 | 4.21 | 62.78 | 10.75 |
| AD-353526.1 | 50.82 | 2.45 | 106.49 | 16.48 |
| AD-356422.1 | 51.12 | 12.80 | 99.93 | 3.64 |
| AD-353519.1 | 43.78 | 4.69 | 109.71 | 25.51 |
| AD-356443.1 | 80.02 | 8.39 | 151.50 | 30.84 |
| AD-357115.1 | 64.98 | 6.65 | 178.41 | 43.34 |
| AD-361493.1 | 29.23 | 6.24 | 136.35 | 20.49 |
| AD-354639.1 | 48.20 | 4.60 | 155.53 | 33.91 |
| AD-356955.1 | 62.09 | 6.19 | 164.98 | 46.88 |
| AD-358471.1 | 31.12 | 3.36 | 108.67 | 37.20 |
| AD-354066.1 | 77.57 | 12.13 | 205.05 | 15.39 |

TABLE 4-continued

HTT Single Dose Screens in BE(2)C Cells

| Duplex | 10 nM Dose Avg % HTT mRNA Remaining | 10 nM Dose SD | 0.1 nM Dose Avg % HTT mRNA Remaining | 0.1 nM Dose SD |
|---|---|---|---|---|
| AD-384665.1 | 62.62 | 11.80 | 51.01 | 1.70 |
| AD-355045.1 | 13.21 | 1.82 | 32.78 | 5.49 |
| AD-353715.1 | 19.44 | 1.85 | 51.85 | 13.55 |
| AD-356429.1 | 35.74 | 7.82 | 76.89 | 14.02 |
| AD-359761.1 | 53.86 | 7.22 | 92.90 | 36.39 |
| AD-356669.1 | 67.14 | 12.99 | 122.69 | 54.26 |
| AD-357684.1 | 38.66 | 2.19 | 171.32 | 21.29 |
| AD-361981.1 | 89.01 | 10.03 | 136.10 | 45.50 |
| AD-355423.1 | 50.85 | 3.22 | 126.34 | 24.37 |
| AD-356956.1 | 45.99 | 3.04 | 152.10 | 57.21 |
| AD-353522.1 | 60.07 | 5.92 | 119.82 | 39.14 |
| AD-354075.1 | 30.04 | 2.60 | 154.25 | 28.87 |
| AD-355059.1 | 32.62 | 6.80 | 43.67 | 9.90 |
| AD-356951.1 | 19.64 | 3.03 | 41.52 | 5.36 |
| AD-353871.1 | 57.71 | 3.61 | 59.99 | 14.88 |
| AD-356996.1 | 36.58 | 9.28 | 77.80 | 17.06 |
| AD-354068.1 | 27.76 | 6.17 | 47.95 | 10.59 |
| AD-356678.1 | 32.90 | 4.26 | 87.03 | 18.12 |
| AD-357963.1 | 45.86 | 6.23 | 132.93 | 44.34 |
| AD-362090.1 | 94.25 | 8.99 | 125.66 | 40.95 |
| AD-355745.1 | 41.18 | 3.07 | 103.13 | 19.96 |
| AD-357066.1 | 90.93 | 13.20 | 112.28 | 36.69 |
| AD-353527.1 | 57.92 | 8.02 | 112.27 | 9.38 |
| AD-354236.1 | 56.76 | 5.34 | 193.83 | 27.51 |
| AD-357750.1 | 7.74 | 2.65 | 18.65 | 3.02 |
| AD-356389.1 | 13.11 | 2.30 | 35.47 | 3.73 |

TABLE 4-continued

HTT Single Dose Screens in BE(2)C Cells

| Duplex | 10 nM Dose Avg % HTT mRNA Remaining | 10 nM Dose SD | 0.1 nM Dose Avg % HTT mRNA Remaining | 0.1 nM Dose SD |
|---|---|---|---|---|
| AD-354939.1 | 18.83 | 5.26 | 49.46 | 4.06 |
| AD-357218.1 | 16.19 | 4.22 | 32.72 | 6.57 |
| AD-354640.1 | 18.37 | 2.59 | 41.06 | 5.66 |
| AD-358018.1 | 25.29 | 8.01 | 63.68 | 15.77 |
| AD-362093.1 | 95.57 | 21.34 | 100.80 | 19.61 |
| AD-356385.1 | 28.71 | 2.03 | 63.42 | 13.57 |
| AD-357069.1 | 31.85 | 2.96 | 90.71 | 14.52 |
| AD-358764.1 | 17.72 | 5.20 | 54.27 | 8.41 |
| AD-354316.1 | 83.70 | 20.63 | 199.24 | 10.55 |
| AD-355775.1 | 61.70 | 17.03 | 158.42 | 20.42 |
| AD-354320.1 | 61.59 | 15.49 | 160.96 | 7.90 |
| AD-355783.1 | 55.33 | 15.69 | 133.29 | 18.94 |
| AD-354322.1 | 191.64 | 54.47 | 179.71 | 36.74 |
| AD-356408.1 | 159.84 | 36.30 | 213.32 | 24.70 |
| AD-354805.1 | 172.07 | 29.14 | 199.39 | 27.62 |
| AD-356409.1 | 83.23 | 12.52 | 173.24 | 19.82 |
| AD-355118.1 | 102.46 | 24.74 | 170.98 | 23.64 |
| AD-358958.1 | 187.06 | 30.88 | 199.91 | 32.39 |
| AD-355422.1 | 72.78 | 24.21 | 226.00 | 37.15 |
| AD-358959.1 | 100.77 | 30.11 | 199.23 | 10.37 |
| AD-355424.1 | 54.88 | 14.67 | 156.21 | 37.30 |
| AD-379420.2 | 162.26 | 36.61 | 179.07 | 34.36 |
| AD-355524.1 | 85.94 | 17.37 | 175.30 | 31.43 |
| AD-379380.2 | 90.64 | 12.90 | 153.32 | 39.65 |

TABLE 7

HTT Single Dose Screens in BE(2)C Cells

| Duplex | 50 nM dose Avg % HTT mRNA Remaining | 50 nM dose SD | 10 nM dose Avg % HTT mRNA Remaining | 10 nM dose SD | 1 nM dose Avg % HTT mRNA Remaining | 1 nM dose SD | 0.1 nM dose Avg % HTT mRNA Remaining | 0.1 nM dose SD |
|---|---|---|---|---|---|---|---|---|
| AD-953583.1 | 65.73 | 3.69 | 68.52 | 3.59 | 81.29 | 4.52 | 81.77 | 7.38 |
| AD-953591.1 | 58.10 | 7.40 | 62.11 | 6.03 | 78.16 | 9.19 | 87.18 | 7.93 |
| AD-953599.1 | 57.26 | 5.59 | 58.05 | 5.65 | 67.00 | 6.55 | 75.18 | 7.92 |
| AD-953607.1 | 76.53 | 11.31 | 78.85 | 9.00 | 89.54 | 4.07 | 93.39 | 7.95 |
| AD-953615.1 | 76.53 | 6.30 | 80.78 | 4.38 | 92.95 | 6.29 | 106.03 | 9.52 |
| AD-953623.1 | 66.90 | 7.69 | 67.88 | 6.90 | 82.93 | 8.14 | 92.69 | 11.53 |
| AD-953630.1 | 94.68 | 3.29 | 101.89 | 11.32 | 104.63 | 8.08 | 105.94 | 3.82 |
| AD-953638.1 | 42.99 | 6.32 | 41.59 | 3.46 | 64.62 | 4.89 | 73.39 | 3.32 |
| AD-953646.1 | 70.95 | 4.23 | 66.70 | 4.72 | 97.86 | 8.88 | 95.46 | 13.41 |
| AD-953654.1 | 100.02 | 6.41 | 98.76 | 5.28 | 101.05 | 3.32 | 94.44 | 9.22 |
| AD-953662.1 | 58.24 | 3.55 | 59.42 | 4.65 | 70.38 | 3.35 | 81.97 | 6.26 |
| AD-953670.1 | 94.50 | 6.27 | 104.75 | 19.49 | 101.22 | 16.84 | 98.02 | 9.61 |
| AD-953584.1 | 75.92 | 8.67 | 64.59 | 3.37 | 83.74 | 4.97 | 83.52 | 8.34 |
| AD-953592.1 | 74.32 | 6.15 | 83.15 | 3.03 | 91.25 | 3.66 | 87.69 | 2.83 |
| AD-953600.1 | 66.63 | 5.56 | 72.19 | 4.32 | 82.18 | 7.79 | 88.40 | 8.30 |
| AD-953608.1 | 39.95 | 1.44 | 37.97 | 2.56 | 50.35 | 1.45 | 59.10 | 4.86 |
| AD-953616.1 | 55.54 | 6.07 | 58.76 | 3.89 | 66.92 | 2.95 | 82.14 | 3.85 |
| AD-953624.1 | 59.50 | 6.03 | 65.30 | 8.40 | 84.89 | 4.79 | 99.56 | 8.34 |
| AD-953631.1 | 58.38 | 5.72 | 65.35 | 6.45 | 51.38 | 25.23 | 91.21 | 10.80 |
| AD-953639.1 | 61.64 | 3.35 | 66.52 | 8.42 | 79.18 | 19.97 | 93.20 | 7.44 |
| AD-953647.1 | 85.61 | 6.31 | 88.65 | 3.05 | 106.42 | 7.45 | 99.83 | 6.89 |
| AD-953655.1 | 104.92 | 13.38 | 100.12 | 4.72 | 115.45 | 11.59 | 102.49 | 2.83 |
| AD-953663.1 | 82.13 | 6.07 | 81.32 | 3.82 | 91.83 | 1.33 | 92.32 | 8.82 |
| AD-953671.1 | 100.07 | 15.43 | 99.10 | 7.82 | 107.01 | 9.34 | 105.01 | 12.00 |
| AD-953585.1 | 68.95 | 9.55 | 61.23 | 3.65 | 74.87 | 7.80 | 81.74 | 7.20 |
| AD-953593.1 | 85.35 | 3.46 | 97.48 | 1.55 | 100.73 | 13.93 | 93.10 | 10.76 |
| AD-953601.1 | 77.13 | 7.42 | 84.97 | 5.15 | 89.10 | 4.71 | 91.41 | 9.31 |
| AD-953609.1 | 46.34 | 3.08 | 47.10 | 5.91 | 51.32 | 1.83 | 64.58 | 5.59 |
| AD-953617.1 | 77.35 | 6.64 | 86.08 | 6.66 | 94.95 | 9.83 | 93.88 | 7.96 |
| AD-953625.1 | 74.64 | 7.17 | 81.66 | 5.25 | 78.02 | 9.39 | 95.15 | 7.25 |
| AD-953632.1 | 77.51 | 7.12 | 89.57 | 9.14 | 90.60 | 3.10 | 98.16 | 23.71 |
| AD-953640.1 | 83.31 | 3.82 | 89.18 | 7.83 | 102.72 | 9.30 | 96.01 | 7.82 |
| AD-953648.1 | 57.67 | 1.63 | 65.09 | 6.24 | 76.89 | 8.29 | 87.91 | 7.83 |

TABLE 7-continued

| HTT Single Dose Screens in BE(2)C Cells | | | | | | | | |
|---|---|---|---|---|---|---|---|---|
| | 50 nM dose | | 10 nM dose | | 1 nM dose | | 0.1 nM dose | |
| Duplex | Avg % HTT mRNA Remaining | SD | Avg % HTT mRNA Remaining | SD | Avg % HTT mRNA Remaining | SD | Avg % HTT mRNA Remaining | SD |
| AD-953656.1 | 99.23 | 7.82 | 93.97 | 6.04 | 105.33 | 7.69 | 114.77 | 15.98 |
| AD-953664.1 | 98.54 | 7.70 | 99.52 | 1.09 | 104.78 | 10.71 | 92.95 | 5.76 |
| AD-953672.1 | 100.25 | 12.34 | 88.22 | 6.82 | 96.10 | 5.13 | 113.16 | 16.49 |
| AD-953586.1 | 55.47 | 7.17 | 51.83 | 2.45 | 70.27 | 6.04 | 85.64 | 11.03 |
| AD-953594.1 | 85.85 | 15.81 | 87.47 | 4.38 | 98.58 | 6.57 | 101.50 | 8.72 |
| AD-953602.1 | 41.93 | 3.04 | 47.45 | 5.33 | 58.52 | 8.83 | 74.66 | 7.74 |
| AD-953610.1 | 38.40 | 3.08 | 43.49 | 5.30 | 53.06 | 6.83 | 69.18 | 8.59 |
| AD-953618.1 | 53.81 | 1.55 | 55.94 | 4.80 | 76.25 | 4.38 | 84.62 | 4.50 |
| AD-953626.1 | 132.27 | 15.59 | 123.27 | 12.89 | 120.22 | 12.84 | 107.76 | 14.81 |
| AD-953633.1 | 98.35 | 3.09 | 111.46 | 12.11 | 109.58 | 14.76 | 107.71 | 14.87 |
| AD-953641.1 | 75.61 | 6.32 | 86.93 | 8.49 | 86.57 | 8.36 | 89.55 | 3.27 |
| AD-953649.1 | 92.18 | 8.31 | 97.93 | 5.62 | 97.81 | 4.37 | 94.25 | 5.70 |
| AD-953657.1 | 69.99 | 10.60 | 85.39 | 4.71 | 101.53 | 6.78 | 112.01 | 13.76 |
| AD-953665.1 | 97.57 | 5.24 | 87.23 | 8.45 | 107.27 | 13.55 | 95.34 | 7.96 |
| AD-953673.1 | 92.01 | 9.92 | 94.45 | 18.78 | 111.78 | 7.01 | 100.86 | 12.99 |
| AD-953587.1 | 68.70 | 6.66 | 61.13 | 3.55 | 74.72 | 0.99 | 75.52 | 5.19 |
| AD-953595.1 | 55.25 | 2.40 | 59.95 | 10.47 | 73.01 | 14.85 | 83.12 | 6.44 |
| AD-953603.1 | 41.36 | 4.30 | 45.84 | 6.02 | 50.82 | 4.36 | 72.34 | 5.27 |
| AD-953611.1 | 30.59 | 6.97 | 42.23 | 5.89 | 49.55 | 3.33 | 58.05 | 4.27 |
| AD-953619.1 | 85.04 | 6.60 | 84.15 | 2.66 | 92.49 | 6.64 | 105.62 | 13.92 |
| AD-953627.1 | 122.45 | 6.77 | 121.67 | 8.15 | 115.37 | 10.37 | 101.98 | 3.81 |
| AD-953634.1 | 94.74 | 5.02 | 98.17 | 2.46 | 94.99 | 4.68 | 103.34 | 14.41 |
| AD-953642.1 | 97.38 | 4.57 | 101.48 | 3.54 | 102.35 | 5.46 | 108.12 | 7.59 |
| AD-953650.1 | 87.24 | 8.42 | 92.14 | 4.81 | 86.84 | 5.30 | 109.74 | 5.84 |
| AD-953658.1 | 84.73 | 6.08 | 89.05 | 8.27 | 97.51 | 11.09 | 98.79 | 13.15 |
| AD-953666.1 | 85.26 | 5.11 | 89.22 | 12.04 | 102.53 | 5.36 | 100.98 | 5.34 |
| AD-953674.1 | 77.69 | 11.54 | 89.93 | 11.06 | 111.28 | 16.28 | 121.78 | 24.22 |
| AD-953588.1 | 61.12 | 3.42 | 52.22 | 3.21 | 74.78 | 6.36 | 81.13 | 3.04 |
| AD-953596.1 | 62.94 | 11.35 | 68.95 | 5.19 | 67.32 | 6.16 | 99.40 | 12.55 |
| AD-953604.1 | 55.03 | 9.69 | 61.31 | 6.72 | 73.83 | 5.30 | 98.96 | 6.64 |
| AD-953612.1 | 43.94 | 3.27 | 48.39 | 4.57 | 52.67 | 1.79 | 58.41 | 6.63 |
| AD-953620.1 | 91.36 | 14.02 | 94.64 | 8.89 | 105.50 | 7.50 | 99.73 | 10.63 |
| AD-953628.1 | 109.80 | 6.56 | 130.58 | 21.51 | 110.07 | 9.27 | 102.73 | 8.48 |
| AD-953635.1 | 65.33 | 12.81 | 71.01 | 5.41 | 78.77 | 14.06 | 102.21 | 16.98 |
| AD-953643.1 | 113.32 | 10.85 | 114.70 | 7.78 | 113.65 | 1.32 | 119.32 | 13.91 |
| AD-953651.1 | 92.51 | 8.51 | 102.42 | 11.22 | 96.93 | 2.88 | 101.02 | 13.41 |
| AD-953659.1 | 110.37 | 6.31 | 110.02 | 7.07 | 114.25 | 8.01 | 102.65 | 2.34 |
| AD-953667.1 | 80.72 | 6.03 | 82.89 | 4.05 | 98.54 | 5.69 | 102.25 | 17.23 |
| AD-953675.1 | 92.90 | 16.65 | 83.78 | 11.99 | 105.12 | 8.40 | 117.15 | 13.27 |
| AD-953589.1 | 36.03 | 3.99 | 37.09 | 3.93 | 47.90 | 8.18 | 65.62 | 8.58 |
| AD-953597.1 | 84.76 | 6.85 | 83.08 | 5.17 | 70.66 | 15.70 | 90.06 | 9.84 |
| AD-953605.1 | 31.15 | 1.73 | 36.82 | 5.10 | 41.77 | 3.33 | 62.59 | 7.87 |
| AD-953613.1 | 40.91 | 2.79 | 50.41 | 8.12 | 57.95 | 6.23 | 82.40 | 11.89 |
| AD-953621.1 | 95.71 | 7.99 | 107.50 | 8.86 | 105.83 | 6.97 | 103.24 | 10.64 |
| AD-953629.1 | 94.99 | 2.17 | 99.81 | 5.71 | 104.87 | 13.34 | 106.22 | 15.58 |
| AD-953636.1 | 34.50 | 2.03 | 44.33 | 6.24 | 53.82 | 3.03 | 69.97 | 4.61 |
| AD-953644.1 | 75.18 | 2.13 | 84.50 | 4.58 | 93.01 | 4.04 | 102.93 | 8.86 |
| AD-953652.1 | 102.12 | 6.62 | 108.95 | 3.92 | 102.50 | 14.43 | 102.09 | 6.83 |
| AD-953660.1 | 100.98 | 4.32 | 105.70 | 9.85 | 103.96 | 9.02 | 105.07 | 15.10 |
| AD-953676.1 | 97.29 | 12.62 | 90.38 | 6.80 | 104.26 | 13.38 | 113.36 | 14.80 |
| AD-953590.1 | 40.56 | 6.67 | 37.30 | 8.25 | 60.77 | 5.55 | 64.45 | 11.54 |
| AD-953598.1 | 47.12 | 5.20 | 48.93 | 3.87 | 66.94 | 9.54 | 75.49 | 4.38 |
| AD-953606.1 | 38.33 | 3.00 | 43.30 | 2.46 | 53.37 | 4.82 | 71.51 | 5.85 |
| AD-953614.1 | 45.05 | 3.95 | 52.34 | 5.39 | 65.63 | 4.84 | 86.96 | 7.13 |
| AD-953622.1 | 84.86 | 8.26 | 87.00 | 6.92 | 93.95 | 6.81 | 91.20 | 5.59 |
| AD-953637.1 | 32.84 | 1.10 | 42.70 | 7.04 | 56.90 | 8.71 | 95.38 | 19.98 |
| AD-953645.1 | 47.64 | 4.52 | 53.70 | 5.27 | 69.42 | 3.59 | 92.71 | 7.28 |
| AD-953653.1 | 105.41 | 8.04 | 111.93 | 16.66 | 102.13 | 12.99 | 106.61 | 10.07 |
| AD-953661.1 | 49.36 | 2.09 | 53.43 | 5.21 | 67.92 | 12.66 | 101.20 | 13.79 |
| AD-953677.1 | 45.65 | 3.56 | 42.77 | 4.59 | 57.33 | 10.35 | 77.95 | 5.43 |
| AD-953685.1 | 48.42 | 10.41 | 46.82 | 4.11 | 63.78 | 7.35 | 86.60 | 11.82 |
| AD-953693.1 | 93.50 | 6.26 | 89.55 | 14.61 | 95.96 | 25.61 | 98.07 | 8.42 |
| AD-953701.1 | 100.99 | 25.01 | 90.05 | 6.66 | 106.35 | 9.81 | 99.41 | 4.05 |
| AD-953709.1 | 111.06 | 20.00 | 99.36 | 11.71 | 107.61 | 8.85 | 111.13 | 31.48 |
| AD-953717.1 | 87.09 | 9.97 | 72.85 | 12.95 | 90.34 | 12.98 | 102.74 | 8.46 |
| AD-953724.1 | 61.62 | 2.67 | 59.42 | 7.22 | 72.38 | 6.31 | 97.59 | 8.53 |
| AD-953732.1 | 36.91 | 3.27 | 36.45 | 2.72 | 49.11 | 4.45 | 75.61 | 9.88 |
| AD-953740.1 | 57.47 | 6.77 | 55.67 | 9.18 | 78.54 | 4.76 | 94.03 | 7.16 |
| AD-953748.1 | 41.94 | 4.36 | 34.60 | 5.45 | 53.28 | 4.89 | 75.42 | 7.20 |
| AD-953756.1 | 26.38 | 1.58 | 25.66 | 2.26 | 31.90 | 4.42 | 52.80 | 4.10 |
| AD-953678.1 | 39.42 | 4.37 | 42.44 | 2.89 | 54.37 | 4.54 | 70.49 | 8.50 |
| AD-953686.1 | 47.73 | 4.51 | 49.18 | 7.58 | 63.76 | 10.38 | 78.32 | 18.31 |

TABLE 7-continued

| HTT Single Dose Screens in BE(2)C Cells | | | | | | | | |
|---|---|---|---|---|---|---|---|---|
| | 50 nM dose | | 10 nM dose | | 1 nM dose | | 0.1 nM dose | |
| Duplex | Avg % HTT mRNA Remaining | SD | Avg % HTT mRNA Remaining | SD | Avg % HTT mRNA Remaining | SD | Avg % HTT mRNA Remaining | SD |
| AD-953694.1 | 78.72 | 6.97 | 85.82 | 12.25 | 97.80 | 10.27 | 111.29 | 11.78 |
| AD-953702.1 | 101.14 | 10.57 | 101.53 | 10.33 | 117.42 | 7.40 | 105.83 | 11.09 |
| AD-953710.1 | 107.38 | 6.85 | 107.87 | 8.46 | 112.98 | 6.08 | 115.03 | 19.01 |
| AD-953718.1 | 105.19 | 12.03 | 102.57 | 14.87 | 108.64 | 7.61 | 104.65 | 7.29 |
| AD-953733.1 | 54.90 | 6.22 | 63.24 | 10.51 | 70.74 | 5.85 | 103.23 | 2.58 |
| AD-953741.1 | 53.57 | 4.65 | 56.02 | 4.29 | 81.67 | 10.58 | 101.25 | 13.78 |
| AD-953749.1 | 82.34 | 4.62 | 81.11 | 7.23 | 94.63 | 7.27 | 100.71 | 11.80 |
| AD-953757.1 | 31.43 | 1.99 | 38.04 | 2.38 | 42.02 | 8.56 | 63.01 | 7.88 |
| AD-953679.1 | 68.32 | 7.90 | 73.96 | 3.66 | 75.85 | 6.87 | 82.08 | 5.08 |
| AD-953687.1 | 54.92 | 7.52 | 54.63 | 7.06 | 65.52 | 8.91 | 83.85 | 14.01 |
| AD-953695.1 | 101.51 | 14.48 | 95.01 | 6.55 | 104.09 | 7.93 | 105.23 | 12.85 |
| AD-953703.1 | 85.19 | 6.51 | 80.28 | 4.95 | 92.69 | 3.83 | 103.61 | 10.67 |
| AD-953711.1 | 112.96 | 8.24 | 109.11 | 7.12 | 120.35 | 12.16 | 106.85 | 15.15 |
| AD-953719.1 | 114.81 | 12.49 | 119.99 | 7.03 | 113.69 | 8.85 | 119.23 | 9.37 |
| AD-953726.1 | 35.11 | 2.22 | 31.46 | 15.34 | 57.67 | 6.30 | 69.34 | 8.95 |
| AD-953734.1 | 65.77 | 6.38 | 69.99 | 3.84 | 81.13 | 3.99 | 106.57 | 11.42 |
| AD-953742.1 | 58.72 | 7.50 | 61.53 | 6.18 | 80.00 | 3.55 | 119.74 | 27.68 |
| AD-953750.1 | 49.32 | 3.17 | 51.48 | 4.12 | 68.72 | 6.03 | 100.69 | 9.29 |
| AD-953758.1 | 44.88 | 3.61 | 44.90 | 4.85 | 63.24 | 5.71 | 84.39 | 11.25 |
| AD-953680.1 | 74.90 | 10.00 | 75.77 | 8.06 | 83.61 | 5.45 | 86.00 | 5.23 |
| AD-953688.1 | 81.42 | 6.03 | 82.20 | 12.97 | 92.96 | 14.02 | 95.86 | 15.69 |
| AD-953696.1 | 72.19 | 7.93 | 67.92 | 6.92 | 94.23 | 6.09 | 104.55 | 13.60 |
| AD-953704.1 | 61.45 | 5.62 | 57.14 | 12.13 | 83.24 | 6.56 | 95.70 | 13.67 |
| AD-953712.1 | 91.32 | 22.75 | 93.92 | 23.35 | 103.07 | 5.72 | 115.58 | 24.96 |
| AD-953720.1 | 49.31 | 2.84 | 54.74 | 6.31 | 73.48 | 3.04 | 104.52 | 14.03 |
| AD-953727.1 | 45.24 | 3.13 | 49.26 | 0.69 | 71.27 | 8.02 | 99.78 | 13.10 |
| AD-953735.1 | 31.95 | 3.33 | 40.15 | 0.28 | 57.09 | 5.22 | 67.75 | 11.15 |
| AD-953743.1 | 78.37 | 2.03 | 85.25 | 4.14 | 108.96 | 9.61 | 117.13 | 18.52 |
| AD-953751.1 | 69.59 | 6.18 | 79.91 | 15.30 | 91.65 | 8.73 | 111.31 | 15.81 |
| AD-953759.1 | 32.77 | 2.20 | 36.29 | 3.15 | 46.58 | 3.68 | 63.10 | 0.91 |
| AD-953681.1 | 63.72 | 8.96 | 62.53 | 10.90 | 69.20 | 7.75 | 73.85 | 14.26 |
| AD-953689.1 | 84.37 | 9.37 | 89.59 | 8.90 | 87.64 | 6.11 | 94.10 | 8.40 |
| AD-953697.1 | 68.67 | 6.28 | 70.47 | 3.84 | 93.16 | 11.56 | 87.50 | 27.30 |
| AD-953705.1 | 76.26 | 9.26 | 82.71 | 9.78 | 101.83 | 5.76 | 113.88 | 25.71 |
| AD-953713.1 | 72.81 | 6.33 | 122.98 | 18.47 | 121.70 | 6.11 | 126.85 | 17.30 |
| AD-953721.1 | 60.09 | 9.07 | 61.94 | 6.28 | 83.99 | 7.06 | 113.53 | 27.30 |
| AD-953728.1 | 95.99 | 7.09 | 108.81 | 4.05 | 105.69 | 2.61 | 114.43 | 15.15 |
| AD-953736.1 | 43.65 | 2.02 | 52.40 | 3.01 | 64.42 | 5.17 | 107.14 | 11.36 |
| AD-953744.1 | 34.38 | 1.85 | 38.20 | 1.43 | 52.26 | 2.92 | 87.44 | 11.10 |
| AD-953752.1 | 39.11 | 3.78 | 42.14 | 3.86 | 55.97 | 4.34 | 65.34 | 13.30 |
| AD-953760.1 | 39.56 | 5.60 | 48.26 | 1.06 | 57.17 | 2.95 | 69.88 | 14.70 |
| AD-953682.1 | 72.92 | 6.13 | 77.05 | 5.65 | 64.24 | 10.41 | 68.65 | 12.16 |
| AD-953690.1 | 56.69 | 5.84 | 63.32 | 3.95 | 69.67 | 3.82 | 87.15 | 7.13 |
| AD-953698.1 | 84.41 | 5.61 | 93.42 | 7.30 | 100.01 | 7.77 | 108.17 | 23.60 |
| AD-953706.1 | 79.57 | 29.33 | 101.33 | 7.52 | 109.13 | 5.67 | 95.20 | 13.29 |
| AD-953714.1 | 111.33 | 25.98 | 125.62 | 15.31 | 121.04 | 5.09 | 121.24 | 16.17 |
| AD-953722.1 | 93.22 | 15.35 | 99.91 | 7.15 | 108.30 | 8.00 | 119.11 | 13.70 |
| AD-953729.1 | 42.66 | 6.10 | 48.25 | 6.35 | 69.79 | 3.86 | 81.80 | 40.67 |
| AD-953737.1 | 86.74 | 4.91 | 92.04 | 8.22 | 106.08 | 8.22 | 112.46 | 14.11 |
| AD-953745.1 | 45.37 | 6.06 | 51.60 | 3.18 | 72.29 | 6.94 | 101.78 | 13.92 |
| AD-953753.1 | 43.19 | 1.55 | 48.00 | 4.80 | 52.93 | 1.12 | 68.38 | 8.85 |
| AD-953761.1 | 39.17 | 3.62 | 48.79 | 4.14 | 67.01 | 4.98 | 107.76 | 31.81 |
| AD-953683.1 | 54.19 | 11.40 | 55.49 | 9.00 | 47.23 | 9.63 | 50.48 | 20.26 |
| AD-953691.1 | 51.35 | 3.73 | 52.28 | 5.39 | 56.24 | 0.80 | 75.71 | 12.94 |
| AD-953699.1 | 64.00 | 6.71 | 70.30 | 2.19 | 77.97 | 8.78 | 76.70 | 4.51 |
| AD-953707.1 | 82.64 | 4.93 | 99.12 | 4.80 | 93.51 | 14.02 | 103.34 | 13.49 |
| AD-953715.1 | 67.17 | 5.00 | 74.93 | 8.83 | 89.71 | 4.29 | 107.26 | 12.67 |
| AD-953723.1 | 53.25 | 5.37 | 57.01 | 4.45 | 60.65 | 5.16 | 72.75 | 16.34 |
| AD-953730.1 | 41.03 | 3.52 | 48.59 | 3.57 | 57.66 | 2.68 | 85.34 | 8.56 |
| AD-953738.1 | 88.72 | 13.13 | 100.11 | 3.39 | 112.47 | 11.06 | 111.34 | 12.58 |
| AD-953746.1 | 40.09 | 4.99 | 42.65 | 2.74 | 56.37 | 4.56 | 80.77 | 15.66 |
| AD-953754.1 | 56.31 | 8.93 | 60.39 | 6.69 | 74.84 | 4.85 | 88.46 | 30.20 |
| AD-953762.1 | 32.45 | 1.33 | 39.24 | 2.29 | 45.27 | 4.18 | 63.80 | 2.81 |
| AD-953684.1 | 33.34 | 3.17 | 33.75 | 3.02 | 36.55 | 4.48 | 65.44 | 4.73 |
| AD-953692.1 | 36.65 | 6.50 | 37.31 | 4.94 | 43.81 | 6.87 | 49.97 | 13.15 |
| AD-953700.1 | 58.41 | 8.15 | 79.31 | 15.47 | 81.12 | 8.60 | 75.62 | 22.12 |
| AD-953708.1 | 88.19 | 10.97 | 104.34 | 10.02 | 89.15 | 12.84 | 95.41 | 18.93 |
| AD-953716.1 | 65.20 | 4.34 | 69.54 | 15.10 | 84.30 | 10.53 | 98.17 | 23.29 |
| AD-953731.1 | 41.68 | 2.39 | 46.72 | 5.76 | 55.67 | 1.61 | 78.17 | 10.58 |

TABLE 7-continued

| HTT Single Dose Screens in BE(2)C Cells | | | | | | | | |
|---|---|---|---|---|---|---|---|---|
| | 50 nM dose | | 10 nM dose | | 1 nM dose | | 0.1 nM dose | |
| Duplex | Avg % HTT mRNA Remaining | SD | Avg % HTT mRNA Remaining | SD | Avg % HTT mRNA Remaining | SD | Avg % HTT mRNA Remaining | SD |
| AD-953739.1 | 67.29 | 5.08 | 75.80 | 4.41 | 84.19 | 5.33 | 85.46 | 21.86 |
| AD-953747.1 | 39.12 | 1.33 | 48.43 | 3.51 | 71.76 | 8.07 | 84.11 | 5.65 |
| AD-953755.1 | 34.37 | 1.72 | 43.66 | 1.92 | 40.70 | 4.34 | 56.45 | 12.42 |

TABLE 10

| HTT Single Dose Screens in BE(2)C Cells | | | | | | | | |
|---|---|---|---|---|---|---|---|---|
| | 50 nM dose | | 10 nM dose | | 1 nM dose | | 0.1 nM dose | |
| Duplex | Avg % HTT mRNA Remaining | SD | Avg % HTT mRNA Remaining | SD | Avg % HTT mRNA Remaining | SD | Avg % HTT mRNA Remaining | SD |
| AD-953857.1 | 16.05 | 2.43 | 18.37 | 6.33 | 37.83 | 3.99 | 61.37 | 32.24 |
| AD-953865.1 | 21.46 | 1.84 | 21.52 | 2.08 | 41.90 | 6.47 | 66.45 | 9.60 |
| AD-953873.1 | 47.68 | 1.44 | 41.42 | 6.98 | 66.65 | 7.70 | 107.00 | 4.95 |
| AD-953881.1 | 57.77 | 5.42 | 61.52 | 12.28 | 71.46 | 8.69 | 93.49 | 10.37 |
| AD-953889.1 | 21.18 | 1.43 | 21.45 | 3.67 | 36.96 | 5.59 | 49.35 | 5.80 |
| AD-953897.1 | 26.52 | 2.95 | 25.80 | 4.38 | 44.35 | 0.36 | 62.96 | 9.00 |
| AD-953904.1 | 15.29 | 2.08 | 14.33 | 1.46 | 27.94 | 3.94 | 38.13 | 10.23 |
| AD-953912.1 | 20.77 | 1.06 | 17.31 | 1.44 | 32.90 | 3.56 | 42.66 | 3.78 |
| AD-953920.1 | 29.21 | 5.44 | 23.86 | 2.65 | 41.37 | 5.53 | 60.07 | 6.41 |
| AD-953928.1 | 26.06 | 5.15 | 23.19 | 2.25 | 45.61 | 1.04 | 59.95 | 10.49 |
| AD-953936.1 | 20.24 | 1.03 | 18.53 | 1.67 | 38.84 | 3.09 | 49.16 | 2.52 |
| AD-953858.1 | 15.45 | 1.79 | 15.12 | 3.49 | 29.10 | 5.63 | 44.55 | 6.67 |
| AD-953866.1 | 22.40 | 0.79 | 19.07 | 1.56 | 33.29 | 1.60 | 61.67 | 5.23 |
| AD-953874.1 | 22.91 | 3.18 | 21.92 | 2.47 | 32.57 | 1.93 | 55.52 | 7.14 |
| AD-953882.1 | 23.56 | 2.92 | 25.69 | 4.05 | 42.19 | 5.80 | 73.33 | 9.11 |
| AD-953890.1 | 22.71 | 1.67 | 24.89 | 2.42 | 37.31 | 6.20 | 49.23 | 5.16 |
| AD-953898.1 | 24.80 | 0.30 | 22.21 | 2.80 | 35.18 | 2.80 | 43.93 | 4.68 |
| AD-953905.1 | 26.85 | 2.44 | 24.82 | 2.69 | 42.91 | 5.14 | 72.01 | 10.43 |
| AD-953913.1 | 25.90 | 1.86 | 25.28 | 1.84 | 43.55 | 7.23 | 69.03 | 11.98 |
| AD-953921.1 | 22.21 | 1.76 | 19.64 | 1.53 | 34.67 | 3.91 | 54.24 | 8.28 |
| AD-953929.1 | 36.47 | 5.87 | 36.02 | 2.85 | 61.06 | 2.86 | 83.91 | 22.13 |
| AD-953937.1 | 16.73 | 0.96 | 19.44 | 3.72 | 31.00 | 4.55 | 34.78 | 4.00 |
| AD-953859.1 | 16.27 | 1.03 | 16.96 | 0.82 | 30.38 | 3.42 | 53.51 | 10.75 |
| AD-953867.1 | 22.01 | 3.84 | 21.97 | 2.10 | 35.05 | 3.59 | 57.11 | 1.53 |
| AD-953875.1 | 24.36 | 1.23 | 26.15 | 2.97 | 38.19 | 2.22 | 74.02 | 8.43 |
| AD-953883.1 | 24.73 | 1.85 | 21.07 | 1.38 | 30.54 | 4.74 | 46.61 | 7.10 |
| AD-953891.1 | 24.26 | 0.86 | 24.22 | 4.04 | 38.49 | 5.50 | 47.81 | 7.76 |
| AD-953899.1 | 24.59 | 2.33 | 20.26 | 2.51 | 31.05 | 4.32 | 41.14 | 13.31 |
| AD-953906.1 | 22.78 | 1.44 | 20.10 | 7.25 | 46.92 | 2.16 | 75.40 | 9.82 |
| AD-953914.1 | 28.46 | 1.16 | 29.74 | 4.80 | 64.66 | 8.34 | 96.65 | 11.03 |
| AD-953922.1 | 19.19 | 1.32 | 19.92 | 3.18 | 29.66 | 1.82 | 34.86 | 3.55 |
| AD-953930.1 | 21.85 | 5.90 | 21.01 | 0.82 | 43.94 | 3.67 | 62.33 | 7.01 |
| AD-953938.1 | 63.20 | 5.78 | 66.64 | 7.02 | 79.51 | 8.87 | 80.39 | 3.46 |
| AD-953860.1 | 19.05 | 4.26 | 18.65 | 0.79 | 33.32 | 5.75 | 48.63 | 5.08 |
| AD-953868.1 | 19.63 | 3.05 | 18.41 | 0.48 | 32.04 | 2.63 | 45.92 | 4.72 |
| AD-953876.1 | 33.16 | 2.94 | 31.85 | 1.36 | 66.49 | 7.48 | 102.46 | 4.40 |
| AD-953884.1 | 14.13 | 2.63 | 16.42 | 2.11 | 29.70 | 2.63 | 38.29 | 1.64 |
| AD-953892.1 | 27.64 | 2.38 | 25.56 | 1.96 | 47.71 | 9.73 | 73.34 | 17.01 |
| AD-953900.1 | 17.05 | 0.96 | 18.87 | 1.40 | 32.04 | 4.65 | 42.31 | 8.16 |
| AD-953907.1 | 26.95 | 3.88 | 22.93 | 2.59 | 39.97 | 8.06 | 71.61 | 4.01 |
| AD-953915.1 | 30.95 | 4.60 | 28.16 | 5.40 | 46.16 | 10.23 | 71.46 | 7.54 |
| AD-953923.1 | 21.89 | 2.66 | 17.20 | 1.12 | 27.43 | 1.64 | 40.87 | 3.85 |
| AD-953931.1 | 27.06 | 2.01 | 27.01 | 2.05 | 42.09 | 4.90 | 63.01 | 3.94 |
| AD-953939.1 | 77.68 | 4.69 | 76.66 | 10.80 | 88.25 | 6.19 | 94.95 | 4.51 |
| AD-953861.1 | 20.65 | 1.55 | 18.60 | 2.50 | 29.63 | 3.05 | 40.90 | 5.14 |
| AD-953869.1 | 21.08 | 2.86 | 21.03 | 2.28 | 33.09 | 2.30 | 55.70 | 4.88 |
| AD-953877.1 | 31.47 | 1.50 | 32.22 | 0.31 | 60.90 | 5.92 | 88.72 | 15.86 |
| AD-953885.1 | 22.81 | 2.02 | 22.11 | 1.91 | 33.11 | 1.36 | 54.46 | 6.06 |
| AD-953893.1 | 25.43 | 3.20 | 26.90 | 1.72 | 35.40 | 3.43 | 58.81 | 5.74 |
| AD-953901.1 | 23.55 | 2.39 | 22.74 | 2.14 | 30.83 | 2.19 | 46.56 | 6.45 |
| AD-953908.1 | 28.14 | 3.66 | 24.79 | 4.32 | 49.98 | 6.67 | 74.89 | 11.28 |
| AD-953916.1 | 20.50 | 1.45 | 20.84 | 3.59 | 32.80 | 3.07 | 55.53 | 5.20 |
| AD-953924.1 | 20.30 | 2.89 | 19.94 | 2.37 | 31.99 | 1.48 | 53.87 | 2.32 |
| AD-953932.1 | 22.26 | 4.04 | 22.14 | 1.06 | 37.97 | 1.68 | 64.51 | 5.33 |
| AD-953940.1 | 78.14 | 8.15 | 84.67 | 10.84 | 91.71 | 2.98 | 95.60 | 7.68 |

TABLE 10-continued

HTT Single Dose Screens in BE(2)C Cells

| Duplex | 50 nM dose Avg % HTT mRNA Remaining | 50 nM dose SD | 10 nM dose Avg % HTT mRNA Remaining | 10 nM dose SD | 1 nM dose Avg % HTT mRNA Remaining | 1 nM dose SD | 0.1 nM dose Avg % HTT mRNA Remaining | 0.1 nM dose SD |
|---|---|---|---|---|---|---|---|---|
| AD-953862.1 | 22.74 | 1.44 | 21.07 | 0.21 | 32.76 | 4.07 | 51.54 | 3.32 |
| AD-953870.1 | 20.18 | 2.42 | 19.12 | 1.30 | 30.42 | 3.19 | 40.34 | 7.91 |
| AD-953878.1 | 33.07 | 2.38 | 31.34 | 3.70 | 53.01 | 3.47 | 88.88 | 9.26 |
| AD-953886.1 | 17.86 | 1.46 | 19.86 | 1.08 | 31.56 | 1.68 | 55.48 | 5.88 |
| AD-953894.1 | 27.61 | 2.51 | 28.83 | 1.74 | 56.14 | 0.45 | 82.15 | 15.86 |
| AD-953902.1 | 18.50 | 2.11 | 19.26 | 1.83 | 28.69 | 1.66 | 37.61 | 5.71 |
| AD-953909.1 | 26.17 | 1.74 | 28.69 | 2.80 | 48.35 | 4.44 | 68.14 | 4.57 |
| AD-953917.1 | 26.83 | 2.16 | 27.61 | 2.62 | 36.73 | 1.02 | 70.07 | 10.65 |
| AD-953925.1 | 46.16 | 7.34 | 44.27 | 1.82 | 71.56 | 4.90 | 107.36 | 4.41 |
| AD-953933.1 | 18.24 | 2.49 | 20.81 | 2.28 | 31.13 | 1.91 | 52.83 | 9.20 |
| AD-953941.1 | 59.99 | 7.78 | 52.78 | 7.30 | 82.81 | 6.48 | 110.20 | 9.13 |
| AD-953863.1 | 32.05 | 2.19 | 28.11 | 1.01 | 34.98 | 0.73 | 50.43 | 7.83 |
| AD-953871.1 | 28.02 | 2.21 | 28.90 | 2.25 | 34.68 | 3.48 | 46.87 | 5.69 |
| AD-953879.1 | 23.07 | 2.42 | 25.80 | 2.96 | 36.76 | 3.23 | 59.20 | 7.03 |
| AD-953887.1 | 18.24 | 1.05 | 20.75 | 1.99 | 28.07 | 2.87 | 41.77 | 7.81 |
| AD-953895.1 | 20.39 | 2.35 | 22.41 | 3.55 | 26.86 | 3.42 | 43.97 | 4.42 |
| AD-953903.1 | 15.66 | 2.01 | 19.65 | 2.14 | 29.56 | 1.93 | 39.81 | 7.11 |
| AD-953910.1 | 23.32 | 4.24 | 23.75 | 2.89 | 37.97 | 3.81 | 62.99 | 3.58 |
| AD-953918.1 | 31.96 | 4.06 | 32.74 | 2.53 | 45.30 | 1.60 | 79.21 | 8.97 |
| AD-953926.1 | 21.45 | 0.48 | 24.19 | 2.05 | 40.34 | 5.85 | 72.83 | 12.05 |
| AD-953934.1 | 23.64 | 1.04 | 25.29 | 0.71 | 38.99 | 2.17 | 67.06 | 7.90 |
| AD-953864.1 | 26.24 | 3.28 | 22.71 | 2.58 | 38.72 | 3.45 | 52.72 | 12.31 |
| AD-953872.1 | 25.36 | 5.20 | 25.00 | 2.09 | 37.92 | 4.88 | 45.09 | 6.85 |
| AD-953880.1 | 21.96 | 1.35 | 23.44 | 2.50 | 37.41 | 4.29 | 49.37 | 9.72 |
| AD-953888.1 | 26.33 | 2.91 | 24.11 | 1.45 | 40.29 | 3.43 | 55.22 | 10.38 |
| AD-953896.1 | 21.04 | 0.64 | 22.26 | 2.38 | 36.44 | 4.77 | 56.58 | 9.76 |
| AD-953911.1 | 22.96 | 1.06 | 24.03 | 2.14 | 37.86 | 2.21 | 66.71 | 11.29 |
| AD-953919.1 | 62.76 | 5.76 | 56.02 | 5.60 | 76.99 | 2.81 | 99.08 | 13.73 |
| AD-953927.1 | 25.86 | 2.58 | 23.39 | 2.44 | 31.73 | 2.85 | 46.22 | 9.20 |
| AD-953935.1 | 16.38 | 1.42 | 17.59 | 1.08 | 29.00 | 3.19 | 53.23 | 4.33 |
| AD-953763.1 | 33.44 | 10.21 | 31.06 | 6.57 | 43.69 | 4.70 | 48.31 | 5.99 |
| AD-953771.1 | 42.75 | 6.50 | 41.28 | 9.16 | 75.61 | 9.00 | 92.60 | 10.47 |
| AD-953779.1 | 27.92 | 5.35 | 31.67 | 9.74 | 37.29 | 4.50 | 57.23 | 5.65 |
| AD-953787.1 | 32.95 | 4.58 | 35.35 | 8.17 | 41.84 | 4.58 | 59.06 | 4.46 |
| AD-953795.1 | 34.28 | 2.28 | 41.91 | 3.73 | 53.55 | 5.26 | 85.25 | 1.65 |
| AD-953803.1 | 61.61 | 10.04 | 46.74 | 4.05 | 83.38 | 4.24 | 110.46 | 5.45 |
| AD-953810.1 | 32.03 | 4.20 | 30.31 | 3.53 | 46.84 | 8.35 | 52.79 | 9.88 |
| AD-953818.1 | 35.62 | 7.77 | 39.33 | 3.83 | 64.80 | 4.51 | 83.71 | 8.90 |
| AD-953834.1 | 38.17 | 10.19 | 39.24 | 9.05 | 69.47 | 5.13 | 84.84 | 12.05 |
| AD-953842.1 | 48.14 | 5.74 | 42.18 | 11.18 | 64.07 | 8.26 | 83.21 | 9.99 |
| AD-953764.1 | 35.95 | 3.92 | 32.36 | 4.78 | 52.82 | 1.31 | 84.76 | 7.49 |
| AD-953772.1 | 34.22 | 7.68 | 38.93 | 10.45 | 43.52 | 4.44 | 68.49 | 4.03 |
| AD-953780.1 | 30.99 | 9.57 | 31.93 | 10.20 | 39.08 | 2.92 | 60.57 | 5.48 |
| AD-953788.1 | 38.27 | 4.23 | 37.18 | 5.59 | 47.91 | 5.42 | 76.84 | 1.80 |
| AD-953796.1 | 42.51 | 6.58 | 44.21 | 4.90 | 67.01 | 5.42 | 102.06 | 6.64 |
| AD-953804.1 | 37.65 | 5.98 | 34.34 | 7.25 | 41.18 | 3.27 | 67.16 | 2.81 |
| AD-953811.1 | 35.49 | 4.59 | 33.88 | 3.83 | 69.90 | 4.22 | 92.57 | 4.77 |
| AD-953819.1 | 72.71 | 8.61 | 64.21 | 4.15 | 84.79 | 6.50 | 115.08 | 3.54 |
| AD-953827.1 | 54.49 | 6.72 | 47.64 | 2.73 | 68.71 | 6.19 | 102.52 | 4.97 |
| AD-953835.1 | 50.86 | 9.70 | 45.75 | 3.45 | 70.68 | 2.02 | 109.76 | 6.91 |
| AD-953843.1 | 40.24 | 13.59 | 34.25 | 4.72 | 42.61 | 4.27 | 72.86 | 11.78 |
| AD-953851.1 | 28.35 | 1.65 | 29.66 | 1.70 | 38.15 | 2.59 | 52.40 | 6.40 |
| AD-953765.1 | 28.75 | 5.69 | 26.86 | 10.34 | 41.08 | 2.80 | 59.02 | 5.49 |
| AD-953773.1 | 47.21 | 11.49 | 44.85 | 8.81 | 49.28 | 4.61 | 75.12 | 5.20 |
| AD-953781.1 | 36.10 | 8.50 | 36.11 | 10.46 | 52.43 | 3.14 | 88.89 | 6.54 |
| AD-953789.1 | 33.84 | 5.38 | 30.41 | 2.64 | 41.12 | 5.33 | 61.12 | 4.22 |
| AD-953797.1 | 50.45 | 9.38 | 48.61 | 3.65 | 74.12 | 3.88 | 107.92 | 12.56 |
| AD-953805.1 | 38.52 | 4.74 | 35.18 | 3.86 | 48.85 | 6.72 | 74.95 | 4.48 |
| AD-953812.1 | 50.94 | 4.43 | 47.30 | 4.06 | 44.30 | 3.90 | 65.73 | 4.56 |
| AD-953828.1 | 41.55 | 3.96 | 36.91 | 1.60 | 48.35 | 3.41 | 84.09 | 2.25 |
| AD-953836.1 | 77.62 | 9.75 | 74.18 | 18.66 | 102.18 | 6.41 | 126.56 | 2.57 |
| AD-953852.1 | 36.55 | 1.38 | 38.33 | 2.34 | 49.12 | 9.28 | 76.84 | 7.57 |
| AD-953766.1 | 26.95 | 4.97 | 26.63 | 9.68 | 34.64 | 4.42 | 55.02 | 6.92 |
| AD-953774.1 | 31.82 | 8.79 | 29.89 | 6.65 | 47.56 | 6.79 | 76.30 | 11.63 |
| AD-953782.1 | 33.99 | 4.66 | 33.27 | 1.66 | 58.33 | 2.52 | 88.13 | 2.99 |
| AD-953790.1 | 35.99 | 9.97 | 36.56 | 5.57 | 52.53 | 6.12 | 76.07 | 5.88 |
| AD-953798.1 | 31.59 | 5.99 | 30.43 | 2.92 | 48.48 | 9.26 | 58.30 | 7.98 |
| AD-953806.1 | 29.95 | 2.89 | 29.95 | 3.45 | 47.19 | 0.64 | 72.89 | 3.91 |
| AD-953813.1 | 35.04 | 6.15 | 31.69 | 2.55 | 37.67 | 2.51 | 55.37 | 5.38 |
| AD-953821.1 | 30.63 | 2.16 | 27.43 | 2.03 | 35.15 | 2.54 | 51.11 | 4.67 |
| AD-953829.1 | 68.42 | 15.84 | 60.97 | 8.15 | 84.94 | 2.74 | 110.99 | 4.30 |
| AD-953837.1 | 36.88 | 3.79 | 32.34 | 0.88 | 41.99 | 3.69 | 79.41 | 5.74 |

TABLE 10-continued

| HTT Single Dose Screens in BE(2)C Cells | | | | | | | | |
|---|---|---|---|---|---|---|---|---|
| | 50 nM dose | | 10 nM dose | | 1 nM dose | | 0.1 nM dose | |
| Duplex | Avg % HTT mRNA Remaining | SD | Avg % HTT mRNA Remaining | SD | Avg % HTT mRNA Remaining | SD | Avg % HTT mRNA Remaining | SD |
| AD-953845.1 | 49.96 | 25.03 | 37.73 | 5.40 | 51.07 | 4.49 | 71.53 | 4.38 |
| AD-953853.1 | 17.30 | 1.56 | 22.03 | 4.16 | 37.46 | 4.85 | 62.29 | 9.25 |
| AD-953767.1 | 24.93 | 5.50 | 28.42 | 10.66 | 40.33 | 3.22 | 69.76 | 2.61 |
| AD-953775.1 | 45.40 | 10.62 | 36.34 | 9.82 | 73.68 | 7.21 | 102.63 | 7.31 |
| AD-953783.1 | 29.99 | 12.53 | 29.51 | 4.63 | 49.16 | 6.13 | 80.74 | 6.86 |
| AD-953791.1 | 30.97 | 8.17 | 29.31 | 7.02 | 46.06 | 7.18 | 74.93 | 6.54 |
| AD-953799.1 | 32.72 | 4.42 | 31.33 | 1.95 | 54.01 | 3.60 | 86.02 | 6.50 |
| AD-953807.1 | 37.52 | 7.06 | 37.17 | 3.09 | 55.11 | 2.71 | 82.01 | 4.66 |
| AD-953822.1 | 33.78 | 5.99 | 30.78 | 3.36 | 46.16 | 8.11 | 69.15 | 2.45 |
| AD-953830.1 | 34.73 | 3.76 | 31.58 | 2.53 | 41.37 | 0.94 | 66.10 | 6.80 |
| AD-953838.1 | 33.55 | 9.39 | 34.52 | 2.10 | 49.15 | 2.33 | 86.79 | 3.75 |
| AD-953846.1 | 33.45 | 7.53 | 33.66 | 5.78 | 50.46 | 4.49 | 78.12 | 13.11 |
| AD-953854.1 | 23.08 | 2.75 | 19.69 | 3.46 | 27.90 | 1.19 | 48.41 | 6.99 |
| AD-953768.1 | 26.98 | 4.47 | 27.38 | 10.87 | 33.82 | 3.92 | 45.54 | 4.57 |
| AD-953776.1 | 39.69 | 16.74 | 31.10 | 7.28 | 54.45 | 2.97 | 90.09 | 8.42 |
| AD-953784.1 | 29.34 | 10.82 | 24.02 | 5.30 | 40.23 | 2.64 | 61.39 | 5.18 |
| AD-953792.1 | 31.76 | 9.30 | 29.07 | 4.26 | 37.11 | 3.03 | 56.21 | 8.23 |
| AD-953800.1 | 29.00 | 3.03 | 28.36 | 1.20 | 35.08 | 3.37 | 55.13 | 4.63 |
| AD-953808.1 | 31.85 | 5.96 | 28.41 | 1.27 | 40.18 | 3.14 | 60.87 | 3.28 |
| AD-953815.1 | 35.68 | 6.34 | 33.39 | 1.73 | 56.62 | 1.49 | 89.20 | 2.68 |
| AD-953823.1 | 47.61 | 8.60 | 43.41 | 7.31 | 76.73 | 6.34 | 105.86 | 12.49 |
| AD-953831.1 | 33.88 | 4.75 | 29.70 | 2.85 | 51.07 | 2.83 | 87.65 | 1.33 |
| AD-953839.1 | 36.98 | 6.09 | 30.68 | 4.56 | 43.56 | 4.04 | 73.41 | 4.37 |
| AD-953847.1 | 36.41 | 2.21 | 28.52 | 3.20 | 37.39 | 4.16 | 50.12 | 2.49 |
| AD-953855.1 | 17.03 | 0.92 | 20.33 | 2.28 | 31.95 | 1.93 | 50.61 | 5.00 |
| AD-953769.1 | 20.41 | 6.91 | 19.71 | 9.17 | 31.58 | 2.32 | 36.59 | 3.40 |
| AD-953777.1 | 27.72 | 11.77 | 25.22 | 7.75 | 41.72 | 3.97 | 70.38 | 3.27 |
| AD-953785.1 | 30.05 | 8.76 | 25.46 | 3.08 | 47.74 | 2.90 | 81.22 | 2.03 |
| AD-953793.1 | 32.70 | 14.69 | 26.09 | 4.10 | 45.08 | 5.84 | 70.67 | 4.24 |
| AD-953801.1 | 38.99 | 5.29 | 35.13 | 6.56 | 41.40 | 2.07 | 60.29 | 1.63 |
| AD-953809.1 | 28.15 | 2.21 | 26.23 | 3.63 | 40.42 | 2.30 | 54.00 | 6.94 |
| AD-953816.1 | 28.53 | 4.61 | 25.41 | 3.81 | 36.82 | 2.32 | 54.76 | 2.99 |
| AD-953824.1 | 30.25 | 1.84 | 30.25 | 1.56 | 58.47 | 3.40 | 80.60 | 4.45 |
| AD-953832.1 | 43.14 | 6.36 | 40.76 | 5.26 | 72.55 | 2.64 | 92.56 | 7.75 |
| AD-953840.1 | 30.53 | 5.72 | 28.62 | 1.53 | 40.53 | 1.46 | 67.24 | 4.83 |
| AD-953848.1 | 24.84 | 5.73 | 25.53 | 2.19 | 28.59 | 3.67 | 43.01 | 1.45 |
| AD-953856.1 | 24.53 | 4.30 | 32.92 | 13.93 | 40.47 | 4.05 | 64.17 | 6.57 |
| AD-953770.1 | 24.22 | 4.79 | 24.71 | 11.20 | 33.60 | 2.40 | 49.01 | 2.65 |
| AD-953778.1 | 25.28 | 9.47 | 20.21 | 6.37 | 33.84 | 2.50 | 48.13 | 5.65 |
| AD-953786.1 | 26.47 | 9.22 | 22.25 | 7.17 | 40.55 | 4.25 | 62.15 | 3.45 |
| AD-953794.1 | 36.49 | 20.58 | 28.21 | 9.14 | 45.54 | 5.69 | 67.37 | 2.13 |
| AD-953802.1 | 35.57 | 5.56 | 25.34 | 4.52 | 42.55 | 3.28 | 64.50 | 4.55 |
| AD-953817.1 | 32.24 | 3.60 | 26.88 | 7.17 | 39.15 | 4.10 | 62.75 | 8.52 |
| AD-953825.1 | 38.84 | 3.96 | 35.19 | 5.34 | 42.76 | 5.17 | 52.16 | 11.63 |
| AD-953833.1 | 25.14 | 4.13 | 26.42 | 6.33 | 38.39 | 5.09 | 50.29 | 8.28 |
| AD-953841.1 | 29.86 | 1.31 | 31.23 | 3.65 | 53.57 | 9.16 | 66.57 | 2.48 |
| AD-953849.1 | 22.59 | 4.11 | 22.30 | 7.94 | 27.51 | 5.06 | 37.40 | 3.16 |

TABLE 13

| HTT Single Dose Screens in BE(2)C Cells | | | | | | | | |
|---|---|---|---|---|---|---|---|---|
| | 50 nM dose | | 10 nM dose | | 1 nM dose | | 0.1 nM dose | |
| Duplex | Avg % HTT mRNA Remaining | SD | Avg % HTT mRNA Remaining | SD | Avg % HTT mRNA Remaining | SD | Avg % HTT mRNA Remaining | SD |
| AD-953943.1 | 25.28 | 8.03 | 29.30 | 6.44 | 32.57 | 12.47 | 46.70 | 13.54 |
| AD-953944.1 | 41.24 | 7.70 | 40.89 | 7.91 | 59.91 | 20.20 | 85.25 | 18.83 |
| AD-953945.1 | 33.55 | 5.45 | 42.11 | 3.45 | 70.29 | 23.77 | 73.31 | 19.65 |
| AD-953946.1 | 52.10 | 8.38 | 60.45 | 8.41 | 81.46 | 14.40 | 91.79 | 18.06 |
| AD-953947.1 | 71.37 | 9.54 | 78.72 | 8.60 | 106.79 | 23.62 | 87.11 | 18.93 |
| AD-953948.1 | 28.84 | 2.55 | 32.11 | 3.84 | 51.95 | 11.17 | 66.84 | 15.72 |
| AD-953949.1 | 27.80 | 2.41 | 28.29 | 0.53 | 48.44 | 9.11 | 57.01 | 13.39 |
| AD-953950.1 | 19.18 | 1.56 | 22.28 | 2.23 | 41.90 | 4.85 | 50.60 | 10.20 |
| AD-953951.1 | 35.52 | 3.47 | 40.06 | 2.38 | 59.55 | 8.65 | 63.30 | 13.81 |
| AD-953952.1 | 40.78 | 3.62 | 47.38 | 6.25 | 73.82 | 14.74 | 83.70 | 15.18 |
| AD-953953.1 | 35.33 | 4.75 | 40.88 | 5.35 | 54.48 | 11.58 | 76.41 | 16.22 |

TABLE 13-continued

HTT Single Dose Screens in BE(2)C Cells

| Duplex | 50 nM dose Avg % HTT mRNA Remaining | 50 nM dose SD | 10 nM dose Avg % HTT mRNA Remaining | 10 nM dose SD | 1 nM dose Avg % HTT mRNA Remaining | 1 nM dose SD | 0.1 nM dose Avg % HTT mRNA Remaining | 0.1 nM dose SD |
|---|---|---|---|---|---|---|---|---|
| AD-953954.1 | 80.48 | 13.33 | 94.11 | 5.00 | 114.77 | 17.14 | 112.09 | 13.16 |
| AD-953955.1 | 61.44 | 7.57 | 67.95 | 5.96 | 100.83 | 16.48 | 112.12 | 11.33 |
| AD-953956.1 | 52.28 | 1.18 | 53.04 | 4.66 | 84.55 | 6.04 | 103.05 | 13.02 |
| AD-953957.1 | 27.47 | 4.33 | 32.42 | 1.80 | 60.62 | 14.19 | 82.35 | 11.15 |
| AD-953958.1 | 42.36 | 8.94 | 52.33 | 5.08 | 101.09 | 14.02 | 74.85 | 14.06 |
| AD-953959.1 | 75.40 | 11.80 | 89.04 | 9.94 | 94.52 | 26.23 | 91.62 | 23.89 |
| AD-953960.1 | 49.59 | 6.40 | 47.82 | 6.33 | 75.30 | 5.89 | 101.99 | 14.34 |
| AD-953961.1 | 43.00 | 5.18 | 47.78 | 8.88 | 70.77 | 3.43 | 80.17 | 9.16 |
| AD-953962.1 | 41.41 | 6.11 | 46.17 | 2.48 | 70.52 | 9.03 | 87.06 | 47.29 |
| AD-953963.1 | 61.88 | 13.44 | 69.79 | 8.45 | 126.67 | 29.69 | 119.20 | 18.58 |
| AD-953964.1 | 49.04 | 4.98 | 43.29 | 2.06 | 73.17 | 16.11 | 95.22 | 10.94 |
| AD-953965.1 | 79.15 | 12.41 | 79.79 | 6.49 | 112.95 | 26.48 | 106.87 | 9.13 |
| AD-953966.1 | 39.29 | 4.71 | 46.51 | 3.06 | 93.79 | 10.89 | 78.31 | 9.71 |
| AD-953967.1 | 102.74 | 15.60 | 102.27 | 8.94 | 113.11 | 28.49 | 123.76 | 9.66 |
| AD-953968.1 | 56.27 | 5.92 | 58.12 | 6.20 | 88.92 | 11.11 | 104.25 | 16.19 |
| AD-953969.1 | 49.05 | 7.61 | 48.14 | 4.34 | 78.67 | 13.96 | 100.12 | 9.43 |
| AD-953970.1 | 73.15 | 6.87 | 77.89 | 3.81 | 114.55 | 15.98 | 122.14 | 27.56 |
| AD-953971.1 | 92.44 | 12.13 | 108.14 | 6.62 | 141.31 | 17.87 | 125.68 | 17.13 |
| AD-953972.1 | 43.95 | 9.17 | 46.62 | 3.59 | 75.63 | 8.78 | 79.19 | 9.91 |
| AD-953973.1 | 58.39 | 7.73 | 62.98 | 3.93 | 110.01 | 14.70 | 117.11 | 19.26 |
| AD-953974.1 | 47.46 | 5.57 | 52.59 | 3.19 | 110.79 | 8.08 | 89.64 | 14.12 |
| AD-953975.1 | 53.14 | 11.39 | 51.38 | 5.50 | 87.70 | 16.68 | 99.11 | 21.62 |
| AD-953976.1 | 49.95 | 4.47 | 52.61 | 3.52 | 83.42 | 12.10 | 98.52 | 19.53 |
| AD-953977.1 | 87.78 | 13.24 | 89.20 | 5.02 | 135.24 | 13.49 | 127.28 | 19.87 |
| AD-953978.1 | 126.71 | 11.93 | 145.34 | 6.50 | 166.62 | 14.28 | 114.56 | 18.35 |
| AD-953979.1 | 48.28 | 4.97 | 51.36 | 1.50 | 68.12 | 7.23 | 102.36 | 19.14 |
| AD-953980.1 | 57.96 | 6.20 | 74.25 | 4.62 | 110.83 | 20.10 | 131.34 | 20.04 |
| AD-953981.1 | 49.45 | 8.32 | 53.06 | 3.50 | 78.64 | 6.37 | 101.33 | 17.60 |
| AD-953982.1 | 33.37 | 2.16 | 42.62 | 3.56 | 64.77 | 7.97 | 73.11 | 11.94 |
| AD-953983.1 | 39.40 | 10.93 | 35.92 | 2.28 | 57.13 | 6.68 | 78.16 | 14.03 |
| AD-953984.1 | 57.27 | 7.41 | 54.74 | 3.56 | 77.90 | 18.18 | 99.74 | 14.21 |
| AD-953985.1 | 130.23 | 15.12 | 137.00 | 5.31 | 137.26 | 18.25 | 128.33 | 32.12 |
| AD-953986.1 | 50.95 | 10.45 | 54.33 | 4.64 | 105.85 | 9.70 | 103.85 | 21.90 |
| AD-953987.1 | 69.56 | 6.28 | 77.39 | 4.68 | 81.55 | 10.03 | 126.82 | 37.96 |
| AD-953988.1 | 66.19 | 16.21 | 91.07 | 11.88 | 112.42 | 22.54 | 142.20 | 17.51 |
| AD-953989.1 | 65.71 | 14.37 | 80.99 | 7.71 | 122.89 | 11.49 | 136.06 | 13.06 |
| AD-953990.1 | 83.61 | 12.96 | 64.84 | 5.57 | 88.44 | 12.20 | 104.08 | 14.59 |
| AD-953991.1 | 94.27 | 13.29 | 80.81 | 9.00 | 101.66 | 8.48 | 113.51 | 9.05 |
| AD-953992.1 | 44.46 | 5.75 | 39.33 | 3.94 | 58.24 | 10.81 | 87.29 | 5.55 |
| AD-953993.1 | 114.46 | 11.88 | 119.55 | 18.54 | 138.88 | 4.29 | 139.56 | 15.56 |
| AD-953994.1 | 109.68 | 16.66 | 113.20 | 13.74 | 85.48 | 22.04 | 132.49 | 25.95 |
| AD-953995.1 | 44.47 | 8.00 | 43.63 | 3.03 | 60.41 | 1.70 | 85.58 | 8.98 |
| AD-953996.1 | 55.33 | 4.94 | 65.39 | 5.34 | 90.87 | 10.20 | 128.94 | 17.18 |
| AD-953997.1 | 54.33 | 4.23 | 54.39 | 5.44 | 91.96 | 7.82 | 107.48 | 13.93 |
| AD-953998.1 | 89.94 | 12.50 | 77.20 | 9.55 | 83.97 | 14.41 | 99.62 | 24.71 |
| AD-953999.1 | 85.41 | 13.43 | 77.50 | 8.43 | 77.70 | 8.48 | 110.99 | 13.64 |
| AD-954000.1 | 120.60 | 19.15 | 112.70 | 6.22 | 85.64 | 27.09 | 120.51 | 15.78 |
| AD-954001.1 | 94.88 | 10.89 | 96.63 | 6.17 | 118.17 | 11.83 | 127.17 | 24.97 |
| AD-954002.1 | 51.53 | 4.49 | 49.17 | 3.34 | 66.31 | 8.86 | 112.46 | 28.45 |
| AD-954003.1 | 123.28 | 14.54 | 118.10 | 13.16 | 157.56 | 23.31 | 135.59 | 15.72 |
| AD-954004.1 | 75.28 | 8.21 | 98.59 | 21.80 | 125.64 | 7.09 | 140.25 | 21.72 |
| AD-954005.1 | 102.97 | 31.98 | 113.10 | 12.44 | 159.34 | 23.27 | 129.47 | 16.72 |
| AD-954006.1 | 97.35 | 19.09 | 94.31 | 15.52 | 71.85 | 14.67 | 92.08 | 15.42 |
| AD-954007.1 | 49.86 | 4.43 | 47.55 | 2.82 | 70.97 | 11.19 | 94.69 | 14.77 |
| AD-954008.1 | 51.41 | 7.18 | 41.24 | 1.97 | 57.95 | 4.19 | 89.30 | 14.74 |
| AD-954009.1 | 89.01 | 12.41 | 84.78 | 3.63 | 107.09 | 5.23 | 97.41 | 9.85 |
| AD-954010.1 | 49.84 | 6.28 | 41.44 | 1.50 | 54.91 | 3.86 | 103.82 | 11.64 |
| AD-954011.1 | 105.29 | 12.79 | 90.10 | 11.94 | 153.30 | 16.20 | 120.57 | 21.63 |
| AD-954012.1 | 90.03 | 8.01 | 87.39 | 8.23 | 140.07 | 15.18 | 132.56 | 20.06 |
| AD-954013.1 | 34.92 | 5.03 | 36.29 | 5.46 | 62.17 | 6.83 | 77.52 | 8.18 |
| AD-954014.1 | 81.22 | 23.88 | 86.33 | 11.49 | 67.65 | 13.37 | 90.11 | 8.95 |
| AD-954015.1 | 70.36 | 13.12 | 60.63 | 5.52 | 66.58 | 5.12 | 90.80 | 13.51 |
| AD-954016.1 | 44.53 | 7.30 | 38.81 | 1.70 | 56.12 | 6.21 | 98.73 | 12.81 |
| AD-954017.1 | 97.19 | 12.84 | 81.90 | 6.70 | 106.75 | 9.38 | 88.14 | 13.94 |
| AD-954018.1 | 72.64 | 8.33 | 65.38 | 3.02 | 84.16 | 6.84 | 72.28 | 35.23 |
| AD-954019.1 | 67.29 | 8.93 | 61.61 | 1.61 | 97.42 | 23.69 | 110.48 | 16.04 |
| AD-954020.1 | 63.68 | 8.73 | 63.56 | 6.39 | 110.81 | 15.91 | 125.91 | 24.47 |
| AD-954021.1 | 100.05 | 21.36 | 92.98 | 5.12 | 127.14 | 10.83 | 116.82 | 15.90 |
| AD-954022.1 | 28.29 | 9.46 | 29.23 | 2.71 | 34.21 | 9.00 | 68.48 | 7.86 |
| AD-954023.1 | 30.29 | 6.42 | 35.88 | 4.22 | 40.46 | 3.69 | 68.43 | 11.76 |
| AD-954024.1 | 50.98 | 9.28 | 46.06 | 4.64 | 52.39 | 4.98 | 87.55 | 10.91 |
| AD-954025.1 | 75.43 | 8.49 | 64.94 | 11.65 | 64.26 | 3.84 | 100.45 | 17.56 |

TABLE 13-continued

| HTT Single Dose Screens in BE(2)C Cells | | | | | | | | |
|---|---|---|---|---|---|---|---|---|
| | 50 nM dose | | 10 nM dose | | 1 nM dose | | 0.1 nM dose | |
| Duplex | Avg % HTT mRNA Remaining | SD | Avg % HTT mRNA Remaining | SD | Avg % HTT mRNA Remaining | SD | Avg % HTT mRNA Remaining | SD |
| AD-954026.1 | 46.65 | 11.78 | 44.30 | 2.74 | 43.02 | 4.24 | 74.87 | 12.89 |
| AD-954027.1 | 57.79 | 8.79 | 54.28 | 8.40 | 67.25 | 12.15 | 100.97 | 18.05 |
| AD-954028.1 | 45.79 | 6.10 | 44.14 | 3.91 | 55.59 | 5.40 | 97.37 | 12.76 |
| AD-954029.1 | 40.81 | 3.90 | 58.93 | 15.43 | 73.62 | 7.62 | 94.19 | 5.76 |
| AD-954030.1 | 43.55 | 12.13 | 52.94 | 11.13 | 73.85 | 21.70 | 99.17 | 16.74 |
| AD-954031.1 | 49.31 | 6.60 | 52.96 | 11.91 | 83.10 | 14.06 | 102.31 | 16.01 |
| AD-954032.1 | 127.12 | 23.82 | 128.56 | 12.32 | 133.30 | 14.88 | 128.31 | 14.51 |
| AD-954033.1 | 73.92 | 10.70 | 80.98 | 18.52 | 113.54 | 30.70 | 130.72 | 14.26 |
| AD-954034.1 | 49.31 | 6.67 | 52.15 | 10.90 | 84.31 | 20.73 | 110.44 | 23.97 |
| AD-954035.1 | 114.40 | 15.11 | 119.60 | 14.69 | 134.36 | 19.21 | 129.08 | 17.91 |
| AD-954036.1 | 43.48 | 8.39 | 47.72 | 10.68 | 67.08 | 8.75 | 106.73 | 21.10 |
| AD-954037.1 | 39.27 | 4.77 | 44.74 | 6.11 | 72.17 | 11.91 | 69.59 | 13.73 |
| AD-954038.1 | 30.64 | 4.65 | 28.78 | 2.96 | 43.66 | 8.99 | 56.53 | 12.31 |
| AD-954039.1 | 36.40 | 11.20 | 30.20 | 5.20 | 39.81 | 8.41 | 53.83 | 9.89 |
| AD-954040.1 | 50.62 | 10.89 | 40.11 | 7.49 | 55.41 | 10.77 | 81.88 | 12.15 |
| AD-954041.1 | 35.66 | 3.12 | 24.01 | 4.69 | 32.00 | 3.54 | 44.11 | 6.53 |
| AD-954042.1 | 41.12 | 8.18 | 24.88 | 4.04 | 44.89 | 6.14 | 61.21 | 11.11 |
| AD-954043.1 | 24.89 | 5.72 | 15.90 | 2.81 | 22.25 | 4.24 | 32.58 | 5.77 |
| AD-954044.1 | 65.02 | 12.76 | 24.80 | 3.20 | 36.34 | 3.58 | 43.61 | 4.19 |
| AD-954045.1 | 29.56 | 5.27 | 33.04 | 8.55 | 45.38 | 9.97 | 61.31 | 9.41 |
| AD-954046.1 | 50.62 | 13.97 | 43.21 | 5.02 | 53.53 | 2.70 | 82.32 | 9.29 |
| AD-954047.1 | 112.14 | 11.02 | 85.80 | 11.37 | 84.42 | 14.84 | 92.74 | 14.20 |
| AD-954048.1 | 45.07 | 4.29 | 39.26 | 5.31 | 61.14 | 4.62 | 76.48 | 11.06 |
| AD-954049.1 | 74.41 | 7.46 | 54.16 | 4.25 | 73.62 | 7.71 | 86.63 | 15.31 |
| AD-954050.1 | 43.19 | 7.71 | 34.41 | 3.69 | 54.34 | 6.87 | 64.75 | 6.48 |
| AD-954051.1 | 40.81 | 4.58 | 27.32 | 4.69 | 35.97 | 4.35 | 48.62 | 5.79 |
| AD-954052.1 | 57.53 | 7.53 | 34.95 | 2.91 | 45.72 | 15.91 | 55.47 | 8.35 |
| AD-954053.1 | 91.59 | 24.57 | 86.71 | 28.24 | 112.72 | 17.38 | 95.41 | 11.00 |
| AD-954054.1 | 97.79 | 27.39 | 72.68 | 9.74 | 92.74 | 9.94 | 97.46 | 7.00 |
| AD-954055.1 | 97.83 | 2.74 | 87.42 | 9.52 | 101.94 | 20.54 | 98.18 | 20.94 |
| AD-954056.1 | 37.01 | 8.47 | 36.02 | 5.25 | 59.20 | 5.18 | 67.31 | 5.75 |
| AD-954057.1 | 72.64 | 27.91 | 60.87 | 7.90 | 92.38 | 4.23 | 97.42 | 11.31 |
| AD-954058.1 | 40.42 | 5.48 | 31.51 | 4.21 | 50.10 | 5.34 | 64.00 | 5.40 |
| AD-954059.1 | 110.34 | 24.77 | 79.75 | 10.33 | 90.93 | 11.33 | 93.25 | 8.24 |
| AD-954060.1 | 105.41 | 10.82 | 68.12 | 9.92 | 67.92 | 19.45 | 77.29 | 9.57 |
| AD-954061.1 | 48.19 | 12.83 | 45.41 | 7.18 | 82.81 | 16.32 | 89.79 | 11.76 |
| AD-954062.1 | 112.79 | 28.14 | 117.81 | 19.59 | 130.07 | 14.97 | 114.35 | 9.21 |
| AD-954063.1 | 69.36 | 6.09 | 65.94 | 8.67 | 103.63 | 13.94 | 103.38 | 7.59 |
| AD-954065.1 | 55.37 | 13.42 | 43.03 | 5.34 | 73.02 | 12.77 | 86.97 | 3.99 |
| AD-954066.1 | 49.73 | 13.11 | 39.91 | 5.94 | 75.64 | 13.85 | 91.95 | 7.81 |
| AD-954067.1 | 87.82 | 13.15 | 64.69 | 7.46 | 98.59 | 18.86 | 93.71 | 14.09 |
| AD-954068.1 | 40.19 | 6.13 | 33.47 | 4.27 | 53.53 | 6.72 | 63.74 | 6.42 |
| AD-954069.1 | 48.15 | 13.31 | 52.79 | 11.46 | 73.81 | 8.41 | 91.06 | 10.26 |
| AD-954070.1 | 65.48 | 11.48 | 75.23 | 15.82 | 115.87 | 3.64 | 102.39 | 5.57 |
| AD-954071.1 | 123.38 | 32.06 | 81.03 | 11.89 | 110.37 | 8.08 | 103.39 | 10.42 |
| AD-954072.1 | 35.49 | 5.00 | 36.19 | 5.15 | 61.74 | 7.13 | 61.94 | 5.11 |
| AD-954073.1 | 85.49 | 23.02 | 67.03 | 5.33 | 111.70 | 10.83 | 105.50 | 19.88 |
| AD-954074.1 | 124.78 | 23.26 | 90.09 | 14.54 | 129.47 | 9.93 | 111.03 | 8.56 |
| AD-954075.1 | 52.62 | 12.43 | 39.80 | 11.15 | 71.55 | 4.83 | 81.99 | 12.05 |
| AD-954076.1 | 73.79 | 11.02 | 45.41 | 7.32 | 74.27 | 6.14 | 89.39 | 6.76 |
| AD-954077.1 | 36.90 | 4.73 | 49.38 | 9.45 | 61.64 | 8.52 | 80.49 | 15.53 |
| AD-954078.1 | 42.82 | 8.28 | 56.34 | 12.92 | 81.78 | 2.08 | 82.10 | 6.11 |
| AD-954079.1 | 146.69 | 40.61 | 152.79 | 32.89 | 150.99 | 10.06 | 109.19 | 12.69 |
| AD-954080.1 | 80.97 | 14.87 | 77.63 | 13.06 | 116.41 | 7.28 | 93.41 | 25.93 |
| AD-954081.1 | 132.71 | 24.87 | 111.25 | 18.32 | 144.22 | 6.86 | 106.52 | 13.53 |
| AD-954082.1 | 53.58 | 11.30 | 49.94 | 8.38 | 90.95 | 15.32 | 102.40 | 14.73 |
| AD-954083.1 | 52.38 | 9.89 | 49.44 | 7.90 | 84.24 | 2.72 | 84.39 | 13.42 |
| AD-954084.1 | 61.73 | 14.66 | 79.26 | 14.19 | 93.30 | 14.70 | 93.82 | 9.65 |
| AD-954085.1 | 36.35 | 5.49 | 44.12 | 5.16 | 54.76 | 3.22 | 55.64 | 7.08 |
| AD-954086.1 | 45.60 | 11.57 | 50.65 | 6.54 | 64.43 | 12.90 | 68.12 | 7.00 |
| AD-954087.1 | 137.98 | 20.04 | 124.29 | 18.80 | 118.93 | 16.69 | 92.84 | 19.91 |
| AD-954088.1 | 41.87 | 8.36 | 52.21 | 6.46 | 78.64 | 3.87 | 62.24 | 2.62 |
| AD-954089.1 | 70.86 | 15.32 | 62.56 | 15.26 | 107.73 | 3.13 | 100.55 | 22.65 |
| AD-954090.1 | 70.40 | 19.51 | 61.35 | 6.11 | 87.91 | 8.25 | 105.18 | 2.75 |
| AD-954091.1 | 37.74 | 5.94 | 45.78 | 7.62 | 63.97 | 11.22 | 98.88 | 15.71 |
| AD-954092.1 | 49.19 | 12.83 | 59.59 | 17.25 | 71.13 | 7.86 | 80.52 | 7.44 |
| AD-954093.1 | 79.76 | 26.13 | 125.17 | 23.01 | 113.91 | 8.99 | 101.46 | 8.08 |
| AD-954094.1 | 61.37 | 8.05 | 78.73 | 5.77 | 91.71 | 19.60 | 84.72 | 14.75 |
| AD-954095.1 | 90.36 | 16.00 | 96.13 | 13.68 | 101.60 | 4.03 | 76.09 | 16.53 |
| AD-954096.1 | 69.55 | 22.01 | 80.82 | 24.89 | 83.29 | 14.39 | 77.15 | 10.78 |
| AD-954097.1 | 50.60 | 5.74 | 60.89 | 7.04 | 81.66 | 15.06 | 93.85 | 17.16 |
| AD-954098.1 | 50.89 | 7.69 | 54.42 | 6.61 | 79.36 | 4.81 | 91.22 | 8.67 |

TABLE 13-continued

HTT Single Dose Screens in BE(2)C Cells

| Duplex | 50 nM dose | | 10 nM dose | | 1 nM dose | | 0.1 nM dose | |
|---|---|---|---|---|---|---|---|---|
| | Avg % HTT mRNA Remaining | SD | Avg % HTT mRNA Remaining | SD | Avg % HTT mRNA Remaining | SD | Avg % HTT mRNA Remaining | SD |
| AD-954099.1 | 44.06 | 10.32 | 40.54 | 3.88 | 51.58 | 11.04 | 66.69 | 8.02 |
| AD-954100.1 | 68.73 | 15.47 | 80.94 | 24.34 | 85.21 | 11.36 | 82.63 | 10.62 |
| AD-954101.1 | 96.29 | 18.69 | 82.73 | 18.38 | 102.29 | 7.72 | 77.19 | 23.29 |
| AD-954102.1 | 97.04 | 16.96 | 107.63 | 40.67 | 106.07 | 24.77 | 94.95 | 9.34 |
| AD-954103.1 | 53.12 | 19.06 | 61.48 | 8.80 | 96.56 | 9.11 | 81.60 | 4.45 |
| AD-954104.1 | 39.24 | 14.17 | 43.90 | 6.64 | 63.80 | 21.66 | 74.13 | 17.46 |
| AD-954105.1 | 92.22 | 40.50 | 92.14 | 6.14 | 121.87 | 12.99 | 117.35 | 4.61 |
| AD-954106.1 | 94.69 | 22.86 | 81.66 | 34.22 | 109.92 | 14.27 | 120.28 | 6.00 |
| AD-954107.1 | 52.54 | 5.70 | 54.68 | 6.50 | 58.71 | 8.77 | 86.39 | 7.37 |
| AD-954108.1 | 32.60 | 9.35 | 36.30 | 8.08 | 52.25 | 9.42 | 65.38 | 12.97 |
| AD-954109.1 | 49.22 | 14.42 | 49.54 | 15.31 | 65.91 | 5.75 | 80.95 | 9.56 |
| AD-954110.1 | 68.41 | 9.31 | 76.51 | 10.13 | 76.09 | 19.11 | 99.23 | 8.36 |
| AD-954111.1 | 92.65 | 22.73 | 101.91 | 26.67 | 98.02 | 8.77 | 94.90 | 10.57 |
| AD-954112.1 | 64.00 | 17.39 | 59.14 | 9.11 | 83.34 | 9.57 | 83.36 | 12.35 |
| AD-954113.1 | 58.25 | 12.41 | 57.75 | 13.56 | 81.37 | 7.99 | 93.07 | 7.70 |
| AD-954114.1 | 71.05 | 16.06 | 77.64 | 9.56 | 87.97 | 8.84 | 109.33 | 15.36 |
| AD-954115.1 | 60.65 | 15.19 | 56.61 | 8.62 | 76.60 | 6.08 | 101.81 | 10.73 |
| AD-954116.1 | 26.64 | 11.15 | 26.49 | 3.81 | 36.33 | 5.62 | 45.17 | 7.32 |
| AD-954117.1 | 52.54 | 12.72 | 40.89 | 8.82 | 55.89 | 4.54 | 67.65 | 7.51 |
| AD-954118.1 | 40.93 | 7.86 | 43.47 | 15.03 | 62.96 | 4.72 | 53.36 | 8.79 |
| AD-954119.1 | 89.09 | 13.93 | 93.53 | 23.25 | 85.36 | 8.16 | 79.38 | 9.09 |
| AD-954120.1 | 108.81 | 24.28 | 103.12 | 24.39 | 96.43 | 3.32 | 95.36 | 8.32 |
| AD-954121.1 | 109.72 | 19.61 | 106.73 | 17.99 | 113.83 | 23.58 | 105.34 | 7.28 |
| AD-954122.1 | 124.06 | 25.59 | 104.70 | 14.12 | 98.12 | 9.91 | 91.42 | 2.87 |

TABLE 16

HTT Single Dose Screens in BE(2)C Cells

| Duplex | 50 nM dose | | 10 nM dose | | 1 nM dose | | 0.1 nM dose | |
|---|---|---|---|---|---|---|---|---|
| | Avg % HTT mRNA Remaining | SD | Avg % HTT mRNA Remaining | SD | Duplex | Avg % HTT mRNA Remaining | SD | Avg % HTT mRNA Remaining |
| AD-954123.1 | 52.02 | 12.80 | 46.66 | 11.06 | 51.72 | 10.80 | 70.22 | 6.18 |
| AD-954131.1 | 37.98 | 5.90 | 34.57 | 5.77 | 56.27 | 5.95 | 74.72 | 6.16 |
| AD-954139.1 | 31.28 | 1.26 | 30.33 | 5.65 | 43.37 | 8.28 | 61.47 | 3.88 |
| AD-954147.1 | 33.48 | 1.73 | 36.49 | 5.47 | 49.67 | 12.95 | 74.93 | 16.31 |
| AD-954155.1 | 55.01 | 1.15 | 66.47 | 0.62 | 91.29 | 8.22 | 78.41 | 9.98 |
| AD-954163.1 | 62.90 | 5.16 | 50.49 | 7.01 | 66.53 | 6.52 | 90.24 | 7.19 |
| AD-954170.1 | 29.27 | 2.86 | 34.63 | 5.08 | 46.01 | 6.99 | 66.85 | 2.30 |
| AD-954178.1 | 43.47 | 4.36 | 41.39 | 2.26 | 79.85 | 16.32 | 87.04 | 14.48 |
| AD-954186.1 | 54.17 | 5.38 | 61.30 | 6.21 | 83.63 | 16.19 | 89.18 | 4.75 |
| AD-954194.1 | 47.87 | 5.42 | 39.24 | 2.46 | 50.47 | 7.85 | 77.94 | 7.02 |
| AD-954202.1 | 70.30 | 6.02 | 59.62 | 8.57 | 62.98 | 11.40 | 81.62 | 14.21 |
| AD-954210.1 | 32.28 | 5.26 | 36.94 | 6.00 | 64.76 | 9.98 | 93.72 | 4.84 |
| AD-954124.1 | 46.70 | 4.05 | 41.03 | 1.99 | 66.79 | 12.84 | 57.90 | 2.15 |
| AD-954132.1 | 81.87 | 6.77 | 63.41 | 9.43 | 84.80 | 13.63 | 84.67 | 7.53 |
| AD-954140.1 | 30.47 | 2.31 | 30.26 | 3.39 | 48.06 | 11.20 | 55.00 | 9.66 |
| AD-954148.1 | 34.16 | 3.45 | 39.06 | 6.94 | 54.16 | 2.59 | 75.41 | 4.55 |
| AD-954156.1 | 42.59 | 5.18 | 43.79 | 9.06 | 70.61 | 10.32 | 74.37 | 10.49 |
| AD-954164.1 | 29.49 | 1.14 | 34.96 | 6.24 | 50.44 | 2.05 | 64.40 | 5.75 |
| AD-954171.1 | 39.79 | 1.38 | 42.98 | 6.89 | 61.44 | 18.83 | 78.26 | 2.31 |
| AD-954179.1 | 78.67 | 4.09 | 90.13 | 10.14 | 116.94 | 15.14 | 96.51 | 6.99 |
| AD-954187.1 | 92.74 | 4.59 | 100.39 | 6.46 | 109.57 | 10.84 | 95.69 | 9.79 |
| AD-954195.1 | 62.30 | 7.07 | 68.94 | 6.67 | 87.94 | 2.35 | 93.65 | 11.99 |
| AD-954203.1 | 40.27 | 2.78 | 39.36 | 4.99 | 59.62 | 12.43 | 69.24 | 3.49 |
| AD-954211.1 | 27.50 | 2.70 | 35.44 | 1.43 | 57.60 | 7.45 | 84.16 | 6.91 |
| AD-954125.1 | 44.62 | 3.51 | 37.71 | 2.42 | 53.96 | 5.73 | 72.84 | 9.76 |
| AD-954133.1 | 44.69 | 1.50 | 45.67 | 5.60 | 72.15 | 4.87 | 91.31 | 13.88 |
| AD-954141.1 | 30.90 | 4.83 | 39.50 | 3.44 | 58.12 | 15.89 | 80.61 | 3.02 |
| AD-954149.1 | 26.66 | 1.89 | 37.09 | 5.81 | 47.06 | 6.03 | 54.88 | 8.32 |
| AD-954157.1 | 76.68 | 6.90 | 86.87 | 14.20 | 123.87 | 14.44 | 96.35 | 2.83 |
| AD-954165.1 | 46.70 | 2.49 | 57.71 | 7.06 | 94.90 | 6.91 | 81.55 | 14.03 |
| AD-954172.1 | 36.92 | 2.44 | 41.21 | 4.86 | 53.31 | 11.00 | 75.26 | 6.57 |
| AD-954180.1 | 58.96 | 1.62 | 61.78 | 3.73 | 83.87 | 13.62 | 95.17 | 6.80 |
| AD-954188.1 | 73.92 | 6.24 | 65.52 | 8.60 | 75.12 | 7.69 | 77.77 | 4.08 |

TABLE 16-continued

HTT Single Dose Screens in BE(2)C Cells

| | 50 nM dose | | 10 nM dose | | 1 nM dose | | 0.1 nM dose | |
|---|---|---|---|---|---|---|---|---|
| Duplex | Avg % HTT mRNA Remaining | SD | Avg % HTT mRNA Remaining | SD | Duplex | Avg % HTT mRNA Remaining | SD | Avg % HTT mRNA Remaining |
| AD-954196.1 | 99.61 | 6.03 | 106.63 | 13.54 | 117.44 | 16.32 | 93.30 | 8.20 |
| AD-954204.1 | 26.94 | 2.60 | 27.10 | 1.95 | 33.35 | 1.88 | 44.67 | 2.25 |
| AD-954212.1 | 42.77 | 2.77 | 53.14 | 1.61 | 76.16 | 7.15 | 101.27 | 15.46 |
| AD-954126.1 | 31.15 | 4.59 | 28.37 | 7.55 | 41.47 | 8.71 | 64.69 | 6.72 |
| AD-954134.1 | 34.95 | 4.43 | 37.04 | 3.07 | 64.75 | 10.62 | 81.41 | 5.61 |
| AD-954142.1 | 85.11 | 5.64 | 76.57 | 8.62 | 103.15 | 15.39 | 104.54 | 3.92 |
| AD-954150.1 | 34.95 | 5.56 | 43.60 | 5.54 | 61.62 | 3.99 | 76.87 | 4.98 |
| AD-954158.1 | 36.70 | 7.95 | 44.96 | 9.26 | 62.06 | 18.09 | 98.72 | 23.25 |
| AD-954166.1 | 51.85 | 3.54 | 71.74 | 8.49 | 99.76 | 6.78 | 101.54 | 8.54 |
| AD-954173.1 | 30.73 | 2.97 | 37.17 | 3.06 | 41.53 | 3.10 | 61.63 | 2.52 |
| AD-954181.1 | 65.36 | 3.45 | 70.56 | 8.63 | 72.93 | 2.04 | 96.04 | 3.73 |
| AD-954189.1 | 38.01 | 3.43 | 47.12 | 5.07 | 62.93 | 1.22 | 76.77 | 7.56 |
| AD-954197.1 | 52.15 | 4.15 | 61.12 | 5.20 | 82.73 | 7.76 | 95.55 | 7.69 |
| AD-954205.1 | 31.38 | 2.29 | 33.79 | 2.85 | 52.38 | 10.33 | 81.33 | 3.38 |
| AD-954213.1 | 24.59 | 2.15 | 30.30 | 2.83 | 40.86 | 3.44 | 66.86 | 6.00 |
| AD-954127.1 | 51.38 | 5.89 | 39.04 | 7.84 | 55.31 | 11.49 | 64.90 | 4.83 |
| AD-954135.1 | 95.14 | 9.88 | 102.58 | 8.08 | 104.48 | 5.54 | 94.95 | 12.83 |
| AD-954143.1 | 41.30 | 4.61 | 43.90 | 3.89 | 71.08 | 2.83 | 93.56 | 2.98 |
| AD-954151.1 | 49.96 | 2.57 | 58.67 | 3.77 | 87.43 | 9.85 | 94.12 | 8.27 |
| AD-954159.1 | 37.64 | 2.71 | 42.68 | 7.34 | 86.42 | 13.02 | 92.18 | 15.52 |
| AD-954167.1 | 64.60 | 10.08 | 62.25 | 24.93 | 104.37 | 19.93 | 79.75 | 5.74 |
| AD-954174.1 | 26.34 | 2.62 | 33.31 | 8.11 | 53.96 | 9.59 | 67.80 | 7.33 |
| AD-954182.1 | 39.88 | 1.79 | 44.29 | 2.43 | 74.11 | 10.67 | 87.71 | 8.66 |
| AD-954190.1 | 31.54 | 2.31 | 34.55 | 2.79 | 52.19 | 6.47 | 71.74 | 4.87 |
| AD-954198.1 | 80.34 | 4.43 | 87.33 | 9.35 | 101.06 | 10.72 | 99.18 | 6.53 |
| AD-954206.1 | 33.58 | 1.34 | 33.90 | 3.58 | 50.24 | 4.96 | 82.01 | 8.04 |
| AD-954214.1 | 23.40 | 2.25 | 31.57 | 2.68 | 38.95 | 2.46 | 63.16 | 9.52 |
| AD-954128.1 | 27.26 | 1.75 | 25.22 | 3.34 | 29.83 | 4.96 | 47.17 | 0.54 |
| AD-954136.1 | 87.99 | 6.49 | 91.17 | 9.71 | 83.92 | 2.27 | 82.07 | 8.82 |
| AD-954144.1 | 29.88 | 2.85 | 33.73 | 4.85 | 43.14 | 7.17 | 69.14 | 6.09 |
| AD-954152.1 | 35.17 | 2.44 | 36.61 | 4.59 | 53.44 | 4.84 | 77.50 | 3.94 |
| AD-954160.1 | 33.26 | 1.92 | 28.97 | 5.90 | 50.16 | 5.97 | 74.36 | 8.41 |
| AD-954168.1 | 42.69 | 3.89 | 49.18 | 4.95 | 68.36 | 12.19 | 71.75 | 5.10 |
| AD-954175.1 | 43.24 | 1.41 | 51.66 | 2.51 | 84.47 | 5.48 | 97.60 | 14.78 |
| AD-954183.1 | 75.62 | 6.73 | 84.16 | 18.23 | 99.04 | 8.72 | 98.12 | 5.76 |
| AD-954191.1 | 38.92 | 1.79 | 46.32 | 7.58 | 71.86 | 10.90 | 103.08 | 3.01 |
| AD-954199.1 | 42.26 | 2.80 | 45.98 | 3.56 | 73.52 | 6.66 | 81.46 | 8.27 |
| AD-954207.1 | 28.21 | 1.56 | 30.80 | 3.11 | 45.83 | 7.89 | 73.61 | 10.14 |
| AD-954215.1 | 21.72 | 1.42 | 27.71 | 2.94 | 43.81 | 4.05 | 75.95 | 9.32 |
| AD-954129.1 | 24.27 | 1.44 | 21.17 | 3.24 | 19.07 | 6.69 | 60.49 | 6.62 |
| AD-954137.1 | 43.53 | 3.12 | 48.64 | 7.04 | 59.95 | 19.21 | 88.81 | 6.41 |
| AD-954145.1 | 32.85 | 2.77 | 33.76 | 10.34 | 56.45 | 10.32 | 88.01 | 10.24 |
| AD-954153.1 | 48.99 | 6.02 | 49.20 | 3.77 | 78.83 | 10.81 | 64.73 | 7.14 |
| AD-954161.1 | 32.14 | 3.02 | 34.48 | 2.60 | 46.36 | 4.16 | 54.76 | 8.47 |
| AD-954169.1 | 34.74 | 2.18 | 35.81 | 3.43 | 61.71 | 5.68 | 75.21 | 5.66 |
| AD-954176.1 | 38.53 | 2.13 | 44.69 | 5.07 | 61.75 | 4.66 | 77.80 | 6.95 |
| AD-954184.1 | 55.56 | 3.60 | 56.59 | 1.49 | 93.42 | 1.56 | 99.69 | 6.36 |
| AD-954192.1 | 100.12 | 11.38 | 98.85 | 0.79 | 101.06 | 14.32 | 110.37 | 16.13 |
| AD-954200.1 | 35.93 | 1.36 | 34.58 | 2.13 | 56.52 | 5.39 | 76.79 | 2.50 |
| AD-954208.1 | 32.18 | 2.82 | 31.64 | 2.62 | 41.68 | 1.38 | 60.48 | 6.31 |
| AD-954216.1 | 23.72 | 2.06 | 30.51 | 2.01 | 49.35 | 4.19 | 81.27 | 3.16 |
| AD-954130.1 | 19.85 | 7.94 | 23.85 | 3.60 | 24.29 | 7.01 | 61.79 | 3.84 |
| AD-954138.1 | 34.61 | 3.77 | 29.28 | 2.86 | 37.50 | 6.25 | 73.17 | 3.15 |
| AD-954146.1 | 30.29 | 4.48 | 28.72 | 4.62 | 46.06 | 8.29 | 71.77 | 2.25 |
| AD-954154.1 | 47.57 | 5.76 | 45.17 | 4.28 | 72.44 | 11.48 | 95.85 | 11.77 |
| AD-954162.1 | 33.21 | 2.19 | 32.86 | 2.61 | 40.48 | 1.74 | 71.90 | 2.58 |
| AD-954177.1 | 44.09 | 4.74 | 41.57 | 7.32 | 64.87 | 6.95 | 84.18 | 6.50 |
| AD-954185.1 | 40.16 | 6.27 | 39.88 | 6.12 | 70.92 | 9.62 | 91.41 | 5.71 |
| AD-954193.1 | 40.67 | 3.75 | 47.36 | 1.96 | 83.44 | 7.54 | 90.57 | 7.54 |
| AD-954201.1 | 88.90 | 6.15 | 86.29 | 11.24 | 93.95 | 13.19 | 75.31 | 5.30 |
| AD-954209.1 | 26.15 | 1.78 | 26.42 | 3.92 | 37.25 | 8.70 | 57.03 | 2.95 |
| AD-954217.1 | 22.08 | 3.65 | 26.35 | 0.46 | 40.24 | 8.85 | 69.89 | 18.22 |
| AD-954225.1 | 32.81 | 0.74 | 45.33 | 7.32 | 67.38 | 4.84 | 104.66 | 12.11 |
| AD-954233.1 | 85.46 | 11.15 | 91.24 | 8.51 | 88.64 | 9.42 | 114.91 | 10.27 |
| AD-954241.1 | 106.86 | 9.14 | 133.05 | 11.27 | 124.00 | 18.20 | 134.56 | 31.54 |
| AD-954249.1 | 33.83 | 3.03 | 45.04 | 2.16 | 54.32 | 8.90 | 81.13 | 9.45 |
| AD-954257.1 | 49.77 | 2.63 | 61.84 | 7.61 | 88.87 | 28.12 | 120.76 | 4.78 |
| AD-954264.1 | 30.81 | 1.88 | 45.45 | 4.97 | 58.79 | 10.96 | 101.10 | 11.20 |
| AD-954272.1 | 32.73 | 1.95 | 45.08 | 6.85 | 62.03 | 12.19 | 93.98 | 8.23 |
| AD-954280.1 | 106.62 | 3.67 | 133.82 | 8.30 | 110.97 | 16.89 | 132.84 | 13.83 |
| AD-954288.1 | 73.24 | 7.83 | 76.91 | 15.22 | 90.96 | 13.48 | 129.55 | 12.49 |

TABLE 16-continued

HTT Single Dose Screens in BE(2)C Cells

| | 50 nM dose | | 10 nM dose | | 1 nM dose | | 0.1 nM dose | |
|---|---|---|---|---|---|---|---|---|
| Duplex | Avg % HTT mRNA Remaining | SD | Avg % HTT mRNA Remaining | SD | Duplex | Avg % HTT mRNA Remaining | SD | Avg % HTT mRNA Remaining |
| AD-954296.1 | 30.93 | 3.59 | 35.55 | 5.19 | 51.27 | 11.72 | 78.93 | 5.41 |
| AD-954218.1 | 26.56 | 3.53 | 28.97 | 3.37 | 38.53 | 8.13 | 64.10 | 5.89 |
| AD-954226.1 | 50.34 | 3.59 | 44.04 | 3.70 | 51.26 | 4.10 | 91.30 | 6.11 |
| AD-954234.1 | 90.21 | 10.40 | 88.98 | 6.99 | 76.60 | 10.14 | 100.15 | 8.01 |
| AD-954242.1 | 82.30 | 7.82 | 103.00 | 6.33 | 101.96 | 16.94 | 130.97 | 9.81 |
| AD-954250.1 | 44.08 | 4.85 | 54.36 | 3.62 | 66.86 | 18.27 | 105.59 | 6.63 |
| AD-954258.1 | 64.12 | 7.04 | 69.51 | 4.38 | 71.00 | 14.41 | 107.71 | 8.55 |
| AD-954265.1 | 44.56 | 2.69 | 69.05 | 0.84 | 77.32 | 15.12 | 119.63 | 11.20 |
| AD-954273.1 | 39.40 | 2.40 | 59.31 | 2.24 | 71.10 | 15.25 | 115.15 | 7.40 |
| AD-954281.1 | 43.61 | 1.85 | 62.18 | 5.17 | 77.33 | 10.83 | 119.66 | 11.64 |
| AD-954289.1 | 120.87 | 10.51 | 152.02 | 7.08 | 119.60 | 23.43 | 135.41 | 10.87 |
| AD-954297.1 | 30.95 | 3.35 | 35.55 | 3.32 | 49.47 | 8.36 | 85.22 | 10.09 |
| AD-954219.1 | 47.42 | 7.81 | 43.53 | 4.97 | 46.70 | 4.05 | 84.71 | 15.02 |
| AD-954227.1 | 31.72 | 1.76 | 36.01 | 1.47 | 50.93 | 2.68 | 97.43 | 10.60 |
| AD-954235.1 | 61.17 | 5.15 | 68.18 | 6.27 | 77.19 | 8.53 | 108.81 | 3.40 |
| AD-954243.1 | 30.31 | 5.06 | 40.81 | 5.97 | 36.38 | 3.93 | 56.86 | 6.40 |
| AD-954251.1 | 50.50 | 4.90 | 60.15 | 2.62 | 65.56 | 11.90 | 110.36 | 11.58 |
| AD-954259.1 | 29.29 | 1.64 | 42.87 | 2.90 | 48.94 | 2.60 | 86.86 | 2.56 |
| AD-954266.1 | 58.75 | 2.34 | 79.79 | 6.51 | 85.54 | 17.99 | 119.76 | 12.98 |
| AD-954274.1 | 103.48 | 10.00 | 136.04 | 14.71 | 107.73 | 18.89 | 119.37 | 6.52 |
| AD-954282.1 | 63.93 | 4.55 | 72.13 | 2.20 | 82.83 | 16.10 | 115.03 | 9.20 |
| AD-954290.1 | 73.27 | 4.25 | 76.95 | 3.77 | 73.76 | 8.96 | 116.13 | 15.67 |
| AD-954298.1 | 95.40 | 16.15 | 116.77 | 3.72 | 95.35 | 16.29 | 116.44 | 4.43 |
| AD-954220.1 | 30.05 | 3.04 | 32.41 | 2.71 | 47.25 | 3.70 | 92.34 | 7.65 |
| AD-954228.1 | 28.75 | 1.80 | 39.35 | 4.39 | 48.16 | 4.85 | 95.79 | 8.46 |
| AD-954236.1 | 51.97 | 2.64 | 61.61 | 12.31 | 74.92 | 7.84 | 112.83 | 3.27 |
| AD-954244.1 | 25.23 | 3.09 | 32.22 | 0.67 | 36.54 | 4.41 | 59.50 | 5.69 |
| AD-954252.1 | 41.80 | 4.89 | 52.60 | 11.56 | 58.19 | 12.54 | 104.28 | 27.43 |
| AD-954260.1 | 32.19 | 0.53 | 47.42 | 3.44 | 50.72 | 6.34 | 93.22 | 6.32 |
| AD-954267.1 | 74.62 | 8.93 | 77.43 | 1.94 | 65.23 | 6.95 | 105.17 | 5.36 |
| AD-954275.1 | 54.18 | 2.72 | 65.06 | 5.80 | 66.73 | 11.88 | 102.06 | 3.54 |
| AD-954283.1 | 38.12 | 2.23 | 49.23 | 2.88 | 49.95 | 10.25 | 94.58 | 3.70 |
| AD-954291.1 | 101.23 | 7.90 | 123.82 | 1.81 | 92.72 | 16.12 | 123.82 | 14.21 |
| AD-954299.1 | 100.34 | 14.27 | 115.52 | 7.80 | 94.48 | 11.11 | 117.27 | 9.31 |
| AD-954221.1 | 29.81 | 2.74 | 28.20 | 3.92 | 35.63 | 5.34 | 61.00 | 7.73 |
| AD-954229.1 | 61.95 | 4.21 | 61.45 | 3.69 | 57.20 | 5.13 | 97.46 | 5.45 |
| AD-954237.1 | 51.14 | 5.39 | 66.14 | 6.61 | 68.62 | 6.00 | 105.63 | 7.44 |
| AD-954245.1 | 54.15 | 6.59 | 59.92 | 7.17 | 73.80 | 4.02 | 108.37 | 7.01 |
| AD-954253.1 | 39.91 | 4.15 | 45.61 | 5.11 | 46.87 | 2.60 | 80.73 | 7.62 |
| AD-954261.1 | 37.65 | 3.22 | 46.65 | 2.61 | 47.75 | 2.08 | 79.75 | 7.69 |
| AD-954268.1 | 73.28 | 4.56 | 76.13 | 6.04 | 69.79 | 10.57 | 103.51 | 12.89 |
| AD-954276.1 | 34.99 | 2.68 | 42.88 | 4.07 | 47.04 | 6.06 | 72.15 | 5.12 |
| AD-954284.1 | 23.70 | 2.57 | 35.98 | 4.80 | 41.75 | 2.69 | 58.05 | 6.27 |
| AD-954292.1 | 36.70 | 2.32 | 49.24 | 3.20 | 70.75 | 7.06 | 109.52 | 10.64 |
| AD-954300.1 | 95.58 | 13.44 | 116.85 | 15.24 | 98.47 | 15.60 | 109.57 | 8.11 |
| AD-954222.1 | 34.43 | 4.82 | 31.52 | 4.46 | 46.36 | 3.69 | 83.27 | 9.62 |
| AD-954230.1 | 24.15 | 0.70 | 28.87 | 2.68 | 35.78 | 9.17 | 61.15 | 3.50 |
| AD-954238.1 | 52.45 | 3.33 | 52.94 | 7.85 | 52.93 | 8.19 | 96.17 | 6.44 |
| AD-954246.1 | 37.41 | 4.41 | 48.17 | 3.67 | 61.41 | 5.39 | 113.20 | 7.83 |
| AD-954254.1 | 54.05 | 4.03 | 59.72 | 10.49 | 58.06 | 5.78 | 93.76 | 3.73 |
| AD-954262.1 | 45.38 | 4.69 | 46.22 | 3.64 | 50.32 | 4.42 | 76.36 | 8.74 |
| AD-954269.1 | 47.10 | 2.89 | 66.30 | 3.54 | 81.45 | 12.33 | 114.12 | 6.38 |
| AD-954277.1 | 48.62 | 4.99 | 66.89 | 3.79 | 79.00 | 10.51 | 104.56 | 14.40 |
| AD-954285.1 | 66.27 | 6.04 | 98.18 | 9.60 | 90.64 | 17.39 | 111.14 | 9.29 |
| AD-954293.1 | 40.39 | 6.73 | 53.53 | 1.35 | 66.11 | 4.95 | 87.61 | 6.50 |
| AD-954301.1 | 104.24 | 15.65 | 129.65 | 11.46 | 95.00 | 13.31 | 115.12 | 10.56 |
| AD-954223.1 | 48.53 | 3.41 | 47.89 | 9.69 | 63.25 | 5.62 | 97.14 | 11.15 |
| AD-954231.1 | 60.66 | 5.40 | 71.72 | 4.73 | 77.55 | 2.90 | 103.25 | 6.93 |
| AD-954239.1 | 34.51 | 1.10 | 39.17 | 2.39 | 52.21 | 8.96 | 91.15 | 6.20 |
| AD-954247.1 | 22.02 | 2.03 | 28.16 | 1.36 | 36.99 | 6.62 | 59.18 | 8.13 |
| AD-954255.1 | 25.12 | 2.48 | 30.60 | 1.38 | 42.70 | 4.95 | 57.04 | 5.98 |
| AD-954263.1 | 41.04 | 6.36 | 50.36 | 4.59 | 61.31 | 3.42 | 100.72 | 5.62 |
| AD-954270.1 | 79.14 | 6.00 | 74.55 | 10.12 | 80.65 | 13.01 | 100.52 | 4.78 |
| AD-954278.1 | 55.56 | 5.50 | 57.02 | 2.83 | 62.72 | 9.15 | 93.46 | 7.86 |
| AD-954286.1 | 73.12 | 6.19 | 92.01 | 5.10 | 87.34 | 10.06 | 105.80 | 7.29 |
| AD-954294.1 | 72.37 | 6.17 | 78.67 | 6.17 | 78.62 | 18.09 | 97.60 | 4.71 |
| AD-954302.1 | 96.95 | 14.38 | 109.14 | 8.35 | 98.40 | 19.02 | 109.36 | 7.78 |
| AD-954224.1 | 46.96 | 10.54 | 45.56 | 7.22 | 64.07 | 6.38 | 88.53 | 29.17 |
| AD-954232.1 | 58.45 | 18.51 | 60.74 | 11.61 | 72.28 | 3.88 | 103.49 | 3.84 |
| AD-954240.1 | 33.07 | 1.88 | 37.40 | 6.08 | 57.76 | 20.62 | 94.18 | 5.99 |
| AD-954248.1 | 30.79 | 4.54 | 32.41 | 4.32 | 47.75 | 9.88 | 84.11 | 7.18 |

TABLE 16-continued

| HTT Single Dose Screens in BE(2)C Cells | | | | | | | | |
|---|---|---|---|---|---|---|---|---|
| | 50 nM dose | | 10 nM dose | | 1 nM dose | | 0.1 nM dose | |
| Duplex | Avg % HTT mRNA Remaining | SD | Avg % HTT mRNA Remaining | SD | Duplex | Avg % HTT mRNA Remaining | SD | Avg % HTT mRNA Remaining |
| AD-954256.1 | 46.98 | 6.73 | 51.72 | 6.39 | 82.38 | 5.87 | 107.79 | 6.63 |
| AD-954271.1 | 57.61 | 6.76 | 69.95 | 3.43 | 83.90 | 4.71 | 115.57 | 17.75 |
| AD-954279.1 | 107.65 | 17.29 | 104.96 | 9.00 | 86.16 | 9.88 | 112.41 | 7.65 |
| AD-954287.1 | 68.75 | 4.71 | 66.42 | 11.11 | 77.12 | 10.56 | 106.01 | 2.85 |
| AD-954295.1 | 39.45 | 1.79 | 40.12 | 3.52 | 61.80 | 8.89 | 102.42 | 7.93 |

TABLE 19

| HTT Single Dose Screens in BE(2)C Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1019439.1 | 26.33 | 2.98 | 33.43 | 1.95 | 44.24 | 3.94 | 69.16 | 16.03 |
| AD-1019442.1 | 26.68 | 3.71 | 38.86 | 6.48 | 42.42 | 6.68 | 55.50 | 5.70 |
| AD-1019438.1 | 26.88 | 5.41 | 33.28 | 10.09 | 38.25 | 3.40 | 64.16 | 11.54 |
| AD-1019408.1 | 27.81 | 2.88 | 38.50 | 5.30 | 63.17 | 11.67 | 89.78 | 38.20 |
| AD-1019426.1 | 28.13 | 3.88 | 39.70 | 14.47 | 53.66 | 23.30 | 64.65 | 30.16 |
| AD-1019440.1 | 30.30 | 4.22 | 33.05 | 6.61 | 37.88 | 7.04 | 60.38 | 10.12 |
| AD-1019410.1 | 31.80 | 4.96 | 32.53 | 10.80 | 50.70 | 8.85 | 89.25 | 55.87 |
| AD-1019405.1 | 32.12 | 5.75 | 40.14 | 8.14 | 54.55 | 11.42 | 82.13 | 14.98 |
| AD-1019422.1 | 32.13 | 2.02 | 42.46 | 5.75 | 51.78 | 2.68 | 67.56 | 3.76 |
| AD-1019407.1 | 33.66 | 6.11 | 58.75 | 11.88 | 80.18 | 12.89 | 125.80 | 26.45 |
| AD-1019418.1 | 36.00 | 10.12 | 51.87 | 18.91 | 97.46 | 22.32 | 72.77 | 13.55 |
| AD-1019436.1 | 36.32 | 3.03 | 43.89 | 2.64 | 60.54 | 5.29 | 72.72 | 8.47 |
| AD-1019406.1 | 36.67 | 7.79 | 40.03 | 5.18 | 54.98 | 16.17 | 72.36 | 12.32 |
| AD-1019417.1 | 37.43 | 9.80 | 34.14 | 9.23 | 47.79 | 12.90 | 60.93 | 25.48 |
| AD-1019372.1 | 37.50 | 8.16 | 34.12 | 3.72 | 60.81 | 10.31 | 103.20 | 13.72 |
| AD-1019375.1 | 37.69 | 9.79 | 34.46 | 6.10 | 49.56 | 5.83 | 66.26 | 5.42 |
| AD-1019444.1 | 38.95 | 4.50 | 43.40 | 1.91 | 37.44 | 18.40 | 52.46 | 14.08 |
| AD-1019448.1 | 39.20 | 2.03 | 42.53 | 9.51 | 54.64 | 8.72 | 66.41 | 8.54 |
| AD-1019365.1 | 40.07 | 3.04 | 45.42 | 6.80 | 59.29 | 8.64 | 68.99 | 4.11 |
| AD-1019374.1 | 40.28 | 3.07 | 33.44 | 4.95 | 52.85 | 8.36 | 66.91 | 6.58 |
| AD-1019402.1 | 41.01 | 6.72 | 58.59 | 9.68 | 75.67 | 6.36 | 80.45 | 48.52 |
| AD-1019441.1 | 43.13 | 4.88 | 42.11 | 20.87 | 49.84 | 11.29 | 83.77 | 30.02 |
| AD-1019399.1 | 44.66 | 6.75 | 51.34 | 3.94 | 83.68 | 16.14 | 85.67 | 7.63 |
| AD-1019378.1 | 45.39 | 6.11 | 41.34 | 1.35 | 64.43 | 5.63 | 87.98 | 16.23 |
| AD-1019419.1 | 45.70 | 15.44 | 47.87 | 15.97 | 64.58 | 24.64 | 61.93 | 9.06 |
| AD-1019423.1 | 46.12 | 3.60 | 50.83 | 12.67 | 59.80 | 7.57 | 78.49 | 12.61 |
| AD-1019437.1 | 46.79 | 2.68 | 67.22 | 9.08 | 64.41 | 5.28 | 91.99 | 18.73 |
| AD-1019376.1 | 47.24 | 5.85 | 45.27 | 11.35 | 48.36 | 7.08 | 66.50 | 11.13 |
| AD-1019373.1 | 48.15 | 6.89 | 41.62 | 12.43 | 58.13 | 8.10 | 68.76 | 4.30 |
| AD-1019435.1 | 52.61 | 4.27 | 52.59 | 14.30 | 71.50 | 18.95 | 83.12 | 30.00 |
| AD-1019411.1 | 52.82 | 14.69 | 58.28 | 29.31 | 89.10 | 24.14 | 92.75 | 40.76 |
| AD-1019434.1 | 53.94 | 4.86 | 57.33 | 16.85 | 69.25 | 9.85 | 73.47 | 12.55 |
| AD-1019377.1 | 57.15 | 11.34 | 52.68 | 7.70 | 77.91 | 11.93 | 81.77 | 11.31 |
| AD-1019412.1 | 62.07 | 14.20 | 88.99 | 17.66 | 102.97 | 21.58 | 84.96 | 13.92 |
| AD-1019403.1 | 64.17 | 7.55 | 65.79 | 13.52 | 91.61 | 8.33 | 78.69 | 11.47 |
| AD-1019368.1 | 64.78 | 8.20 | 58.57 | 2.18 | 65.86 | 2.46 | 64.57 | 20.59 |
| AD-1019404.1 | 64.98 | 13.39 | 89.42 | 25.45 | 92.10 | 13.45 | 84.96 | 32.65 |
| AD-1019415.1 | 67.27 | 9.53 | 78.07 | 17.87 | 82.38 | 19.31 | 77.82 | 2.74 |
| AD-1019421.1 | 69.68 | 26.22 | 66.48 | 16.26 | 88.04 | 26.99 | 80.85 | 17.61 |
| AD-1019400.1 | 69.82 | 32.75 | 98.86 | 18.21 | 87.73 | 31.20 | 90.88 | 24.31 |
| AD-1019450.1 | 70.95 | 8.42 | 66.87 | 9.62 | 60.36 | 4.15 | 74.24 | 7.35 |
| AD-1019420.1 | 71.07 | 8.19 | 72.14 | 21.72 | 75.76 | 10.39 | 75.64 | 7.13 |
| AD-1019429.1 | 77.16 | 3.18 | 90.72 | 8.30 | 85.69 | 8.68 | 76.60 | 9.44 |
| AD-1019431.1 | 77.28 | 13.02 | 84.76 | 20.09 | 100.34 | 25.59 | 105.70 | 37.13 |
| AD-1019428.1 | 77.77 | 17.48 | 97.53 | 47.95 | 103.57 | 36.26 | 80.54 | 9.56 |
| AD-1019364.1 | 80.17 | 3.62 | 81.84 | 3.20 | 83.89 | 5.46 | 81.75 | 8.87 |
| AD-1019413.1 | 80.67 | 7.77 | 80.97 | 20.54 | 88.80 | 7.99 | 119.10 | 30.63 |
| AD-1019394.1 | 82.14 | 16.56 | 92.68 | 2.28 | 90.83 | 19.90 | 111.52 | 47.91 |
| AD-1019398.1 | 82.85 | 6.81 | 97.08 | 13.06 | 91.52 | 2.80 | 71.62 | 2.97 |
| AD-1019366.1 | 82.97 | 11.84 | 66.97 | 7.23 | 68.08 | 7.16 | 80.92 | 4.98 |
| AD-1019432.1 | 83.34 | 10.98 | 64.39 | 6.32 | 64.34 | 3.93 | 69.63 | 8.62 |

TABLE 19-continued

| HTT Single Dose Screens in BE(2)C Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1019380.1 | 85.03 | 3.70 | 63.09 | 1.84 | 81.38 | 13.03 | 62.93 | 3.56 |
| AD-1019382.1 | 85.70 | 14.67 | 75.64 | 7.28 | 78.99 | 5.79 | 87.44 | 19.58 |
| AD-1019433.1 | 85.75 | 8.79 | 74.83 | 26.05 | 75.50 | 7.52 | 77.17 | 6.31 |
| AD-1019424.1 | 86.03 | 27.07 | 111.91 | 28.13 | 114.99 | 40.63 | 94.47 | 25.23 |
| AD-1019445.1 | 87.45 | 4.61 | 62.08 | 7.20 | 67.40 | 9.96 | 83.68 | 8.22 |
| AD-1019369.1 | 88.75 | 2.36 | 81.44 | 4.07 | 80.67 | 3.48 | 84.85 | 6.30 |
| AD-1019416.1 | 88.97 | 26.98 | 108.80 | 23.13 | 98.81 | 15.56 | 103.92 | 50.76 |
| AD-1019414.1 | 89.03 | 31.13 | 88.38 | 23.35 | 102.76 | 22.08 | 76.13 | 4.19 |
| AD-1019447.1 | 89.66 | 8.74 | 92.05 | 6.89 | 89.43 | 5.66 | 101.69 | 11.25 |
| AD-1019430.1 | 90.85 | 13.22 | 90.65 | 18.57 | 80.62 | 5.48 | 80.44 | 3.57 |
| AD-1019395.1 | 91.51 | 12.21 | 111.33 | 32.95 | 113.73 | 28.10 | 127.67 | 17.84 |
| AD-1019396.1 | 94.92 | 23.01 | 131.79 | 38.35 | 115.27 | 26.56 | 88.98 | 30.90 |
| AD-1019425.1 | 95.56 | 39.01 | 125.04 | 41.22 | 107.52 | 38.03 | 73.18 | 10.07 |
| AD-1019363.1 | 95.63 | 3.09 | 98.66 | 7.36 | 84.59 | 9.55 | 83.52 | 8.42 |
| AD-1019367.1 | 96.44 | 1.76 | 78.39 | 11.85 | 79.42 | 8.52 | 74.82 | 4.01 |
| AD-1019362.1 | 96.52 | 7.99 | 88.17 | 3.46 | 87.20 | 3.05 | 94.83 | 3.84 |
| AD-1019379.1 | 96.93 | 11.61 | 73.07 | 12.46 | 98.79 | 10.34 | 104.71 | 43.49 |
| AD-1019397.1 | 97.03 | 16.47 | 99.20 | 7.94 | 103.74 | 15.25 | 99.16 | 16.51 |
| AD-1019392.1 | 97.50 | 22.45 | 111.56 | 11.32 | 138.55 | 20.34 | 162.41 | 22.14 |
| AD-1019409.1 | 98.27 | 12.80 | 99.07 | 45.47 | 110.14 | 36.07 | 134.23 | 68.21 |
| AD-1019361.1 | 101.31 | 14.87 | 88.47 | 3.31 | 83.03 | 9.78 | 86.55 | 9.54 |
| AD-1019449.1 | 101.70 | 20.46 | 78.57 | 11.74 | 78.12 | 4.92 | 77.69 | 6.15 |
| AD-1019385.1 | 101.87 | 13.51 | 98.46 | 12.91 | 131.69 | 33.41 | 115.89 | 43.86 |
| AD-1019427.1 | 102.55 | 21.14 | 161.66 | 45.26 | 103.28 | 32.72 | 106.18 | 5.53 |
| AD-1019390.1 | 105.47 | 9.42 | 92.76 | 10.07 | 90.93 | 13.19 | 86.69 | 17.46 |
| AD-1019383.1 | 105.74 | 7.88 | 73.94 | 4.49 | 76.20 | 3.46 | 73.73 | 1.51 |
| AD-1019401.1 | 105.91 | 15.85 | 122.03 | 11.39 | 137.21 | 26.94 | 109.80 | 41.71 |
| AD-1019393.1 | 106.21 | 29.14 | 105.07 | 19.55 | 126.94 | 46.57 | 101.66 | 32.44 |
| AD-1019370.1 | 106.28 | 18.22 | 82.52 | 11.42 | 84.49 | 11.58 | 76.24 | 3.39 |
| AD-1019391.1 | 107.20 | 42.41 | 92.50 | 15.30 | 110.58 | 15.64 | 94.73 | 13.97 |
| AD-1019446.1 | 107.77 | 12.57 | 91.32 | 14.53 | 78.41 | 9.44 | 83.59 | 12.05 |
| AD-1019371.1 | 109.09 | 39.35 | 77.55 | 9.57 | 88.12 | 10.89 | 94.98 | 22.84 |
| AD-1019386.1 | 109.52 | 12.16 | 106.26 | 21.94 | 124.32 | 16.83 | 147.23 | 17.76 |
| AD-1019389.1 | 120.92 | 6.39 | 89.68 | 12.49 | 94.77 | 10.01 | 90.44 | 19.57 |
| AD-1019387.1 | 135.14 | 7.97 | 102.51 | 12.39 | 108.16 | 17.75 | 95.03 | 42.80 |
| AD-1019381.1 | 142.40 | 16.59 | 86.79 | 21.01 | 106.55 | 17.10 | 86.46 | 17.57 |

TABLE 22

| HTT Single Dose Screens in Hep3B Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1019427 | 138.10 | 1.80 | 106.69 | 9.66 | 110.69 | 6.95 | 82.33 | 1.04 |
| AD-1019428 | 122.96 | 8.54 | 123.38 | 18.73 | 143.60 | 19.65 | 85.92 | 4.79 |
| AD-1019429 | 159.97 | 25.69 | 127.20 | 20.43 | 169.69 | 7.54 | 102.37 | 11.52 |
| AD-1019430 | 183.50 | 24.67 | 141.83 | 30.68 | 165.83 | 16.88 | 90.68 | 5.39 |
| AD-1019431 | 122.49 | 13.91 | 99.24 | 19.93 | 134.14 | 12.03 | 82.93 | 2.70 |
| AD-1019432 | 94.78 | 5.80 | 81.95 | 16.55 | 106.91 | 10.11 | 78.58 | 2.06 |
| AD-1019433 | 85.34 | 8.81 | 70.69 | 7.49 | 99.44 | 9.50 | 78.06 | 6.13 |
| AD-1019434 | 66.47 | 0.79 | 49.38 | 3.88 | 76.15 | 9.24 | 77.24 | 2.61 |
| AD-1019435 | 106.08 | 23.50 | 77.75 | 10.92 | 88.27 | 2.79 | 104.29 | 24.58 |
| AD-1019436 | 112.04 | 11.84 | 119.35 | 16.71 | 115.61 | 11.36 | 110.74 | 26.21 |
| AD-1019437 | 139.88 | 16.93 | 130.38 | 10.92 | 134.78 | 14.02 | 117.90 | 19.13 |
| AD-1019438 | 68.19 | 8.66 | 71.56 | 12.22 | 74.56 | 10.01 | 80.95 | 23.59 |
| AD-1019439 | 62.16 | 6.48 | 50.77 | 5.23 | 81.31 | 7.53 | 84.51 | 12.58 |
| AD-1019440 | 56.89 | 5.93 | 46.04 | 4.27 | 70.32 | 11.39 | 79.98 | 8.10 |
| AD-1019441 | 70.06 | 5.54 | 42.12 | 4.50 | 89.04 | 2.93 | 82.56 | 7.31 |
| AD-1019442 | 48.73 | 5.66 | 34.56 | 5.17 | 60.32 | 6.46 | 77.28 | 3.85 |
| AD-1019444 | 103.32 | 16.53 | 71.56 | 8.89 | 90.43 | 14.68 | 110.64 | 14.14 |
| AD-1019445 | 201.07 | 51.82 | 144.95 | 19.20 | 144.50 | 22.60 | 100.27 | 11.62 |
| AD-1019446 | 191.30 | 81.87 | 137.09 | 38.39 | 191.26 | 8.82 | 158.08 | 19.82 |

TABLE 22-continued

| HTT Single Dose Screens in Hep3B Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1019447 | 184.26 | 22.26 | 167.74 | 43.07 | 148.71 | 32.03 | 113.94 | 14.67 |
| AD-1019448 | 99.85 | 6.52 | 75.18 | 11.48 | 128.40 | 10.49 | 121.88 | 27.56 |
| AD-1019449 | 156.40 | 22.70 | 114.59 | 8.29 | 132.89 | 16.45 | 100.24 | 17.33 |
| AD-1019450 | 161.29 | 65.73 | 92.49 | 15.35 | 119.28 | 11.41 | 93.35 | 4.75 |

TABLE 23

| HTT Single Dose Screens in PCH Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1019427 | 101.37 | 9.26 | 156.06 | 40.24 | 138.20 | 35.12 | 140.07 | 40.07 |
| AD-1019428 | 92.49 | 6.19 | 135.48 | 22.38 | 118.19 | 5.27 | 119.47 | 16.68 |
| AD-1019429 | 98.97 | 6.65 | 131.39 | 12.98 | 130.93 | 6.30 | 128.81 | 26.81 |
| AD-1019430 | 100.45 | 5.26 | 129.08 | 14.59 | 125.01 | 11.13 | 126.55 | 16.02 |
| AD-1019431 | 98.21 | 8.32 | 145.07 | 10.68 | 127.63 | 7.57 | 141.36 | 10.73 |
| AD-1019432 | 106.29 | 3.11 | 168.38 | 37.13 | 136.01 | 22.40 | 131.93 | 16.42 |
| AD-1019433 | 102.70 | 8.23 | 161.01 | 12.53 | 139.06 | 5.13 | 145.64 | 6.63 |
| AD-1019434 | 129.67 | 17.06 | 154.19 | 12.23 | 158.96 | 23.34 | 188.71 | 33.63 |
| AD-1019435 | 104.54 | 9.16 | 131.00 | 4.95 | 106.67 | 10.72 | 107.91 | 15.44 |
| AD-1019436 | 93.90 | 5.21 | 119.23 | 11.41 | 118.13 | 13.87 | 97.48 | 5.83 |
| AD-1019437 | 100.62 | 5.20 | 119.08 | 14.80 | 134.47 | 18.41 | 109.63 | 9.43 |
| AD-1019438 | 84.11 | 2.20 | 117.95 | 22.08 | 117.34 | 12.05 | 103.38 | 9.16 |
| AD-1019439 | 98.67 | 3.66 | 135.71 | 12.20 | 124.13 | 7.31 | 135.45 | 7.08 |
| AD-1019440 | 83.61 | 4.58 | 99.43 | 3.05 | 116.11 | 3.48 | 127.08 | 7.79 |
| AD-1019441 | 82.45 | 4.43 | 137.14 | 12.07 | 119.26 | 6.58 | 130.27 | 3.07 |
| AD-1019442 | 120.65 | 12.47 | 153.01 | 14.74 | 135.81 | 15.03 | 176.38 | 33.63 |
| AD-1019444 | 97.66 | 4.03 | 120.60 | 17.75 | 103.85 | 6.35 | 103.97 | 10.02 |
| AD-1019445 | 94.35 | 7.61 | 120.88 | 24.22 | 102.70 | 4.30 | 94.75 | 4.03 |
| AD-1019446 | 92.74 | 4.59 | 107.26 | 12.05 | 114.16 | 5.03 | 95.74 | 4.00 |
| AD-1019447 | 88.37 | 11.45 | 108.43 | 8.25 | 111.92 | 15.15 | 93.29 | 14.63 |
| AD-1019448 | 45.33 | 4.67 | 62.29 | 8.67 | 101.08 | 7.47 | 94.82 | 8.72 |
| AD-1019449 | 98.22 | 15.96 | 112.71 | 12.36 | 131.04 | 8.72 | 105.94 | 11.80 |
| AD-1019450 | 85.07 | 15.81 | 97.62 | 10.72 | 107.02 | 2.92 | 127.99 | 8.39 |

TABLE 26

| HTT Single Dose Screens in BE(2)C Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1019451 | 93.29 | 16.82 | 79.48 | 6.60 | 117.48 | 21.67 | 86.30 | 7.18 |
| AD-1019452 | 99.01 | 13.04 | 95.58 | 11.01 | 108.44 | 12.82 | 96.63 | 5.59 |
| AD-1019453 | 87.05 | 7.20 | 113.35 | 13.73 | 94.72 | 2.78 | 98.74 | 13.68 |
| AD-1019454 | 119.73 | 25.89 | 106.85 | 10.68 | 98.62 | 4.77 | 103.14 | 10.90 |
| AD-1019455 | 82.82 | 7.22 | 103.85 | 19.64 | 118.66 | 29.10 | 97.17 | 11.43 |
| AD-1019456 | 130.50 | 23.39 | 97.94 | 18.86 | 98.21 | 6.84 | 105.81 | 7.47 |
| AD-1019457 | 113.79 | 27.33 | 98.22 | 13.18 | 94.59 | 15.31 | 104.74 | 12.62 |
| AD-1019458 | 105.55 | 18.22 | 81.42 | 3.46 | 95.90 | 9.68 | 97.59 | 10.26 |
| AD-1019459 | 86.39 | 6.10 | 82.18 | 7.18 | 86.45 | 7.09 | 86.03 | 7.52 |
| AD-1019460 | 86.54 | 26.91 | 73.97 | 4.97 | 89.26 | 22.30 | 87.31 | 2.77 |
| AD-1019461 | 101.49 | 23.41 | 102.71 | 17.25 | 128.66 | 12.07 | 95.42 | 4.26 |

TABLE 26-continued

| HTT Single Dose Screens in BE(2)C Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1019462 | 91.96 | 6.71 | 107.73 | 16.29 | 112.32 | 21.80 | 88.42 | 4.11 |
| AD-1019463 | 90.33 | 25.45 | 88.82 | 11.53 | 97.45 | 10.80 | 105.73 | 11.70 |
| AD-1019464 | 96.47 | 8.69 | 105.84 | 6.30 | 107.74 | 8.91 | 92.45 | 2.58 |
| AD-1019465 | 39.56 | 9.26 | 44.15 | 1.46 | 54.35 | 15.13 | 81.22 | 10.35 |
| AD-1019466 | 73.77 | 16.43 | 58.74 | 8.97 | 71.43 | 15.68 | 82.76 | 3.09 |
| AD-1019467 | 86.04 | 21.44 | 63.29 | 4.25 | 73.17 | 11.29 | 89.01 | 3.28 |
| AD-1019468 | 37.14 | 2.38 | 40.49 | 8.69 | 46.65 | 3.92 | 76.47 | 6.65 |
| AD-1019469 | 55.50 | 7.49 | 58.16 | 7.02 | 71.59 | 3.80 | 92.31 | 9.48 |
| AD-1019470 | 30.87 | 5.33 | 42.49 | 5.00 | 49.71 | 8.12 | 84.22 | 9.04 |
| AD-1019471 | 39.47 | 5.81 | 38.61 | 4.32 | 49.39 | 4.07 | 76.09 | 6.89 |
| AD-1019472 | 36.94 | 6.56 | 38.58 | 5.74 | 59.19 | 9.03 | 92.89 | 15.63 |
| AD-1019473 | 44.28 | 4.57 | 41.08 | 5.92 | 58.70 | 14.41 | 96.29 | 18.47 |
| AD-1019474 | 23.10 | 2.15 | 26.69 | 3.41 | 47.74 | 11.81 | 58.58 | 8.93 |
| AD-1019475 | 79.15 | 38.02 | 75.33 | 20.13 | 78.21 | 15.30 | 96.03 | 6.92 |
| AD-1019476 | 29.76 | 0.61 | 34.60 | 6.18 | 36.90 | 9.22 | 61.84 | 4.44 |
| AD-1019477 | 32.07 | 3.21 | 37.52 | 1.42 | 50.16 | 16.87 | 88.20 | 6.09 |
| AD-1019478 | 35.78 | 6.14 | 46.00 | 8.07 | 56.02 | 5.51 | 93.58 | 9.49 |
| AD-1019479 | 82.43 | 14.10 | 79.61 | 12.60 | 79.91 | 1.40 | 90.84 | 6.32 |
| AD-1019480 | 73.10 | 10.82 | 64.04 | 5.81 | 76.54 | 2.46 | 88.44 | 4.59 |
| AD-1019481 | 61.17 | 5.75 | 50.82 | 2.01 | 61.45 | 4.92 | 83.66 | 18.29 |
| AD-1019482 | 37.37 | 4.04 | 46.32 | 5.39 | 65.74 | 8.11 | 86.94 | 5.01 |
| AD-1019483 | 38.58 | 7.74 | 36.51 | 3.09 | 52.26 | 5.18 | 77.39 | 6.67 |
| AD-1019484 | 24.49 | 2.05 | 30.55 | 2.75 | 35.81 | 8.29 | 66.74 | 4.82 |
| AD-1019485 | 28.44 | 1.78 | 32.61 | 4.65 | 37.42 | 6.84 | 60.91 | 7.85 |
| AD-1019486 | 46.24 | 9.01 | 45.45 | 5.18 | 53.16 | 7.81 | 76.82 | 2.97 |
| AD-1019487 | 39.72 | 7.09 | 41.07 | 5.67 | 53.60 | 9.86 | 79.86 | 4.54 |
| AD-1019488 | 49.71 | 3.57 | 45.89 | 6.61 | 52.78 | 5.90 | 82.82 | 17.59 |
| AD-1019489 | 39.41 | 10.74 | 30.19 | 5.45 | 46.89 | 3.86 | 66.60 | 15.82 |
| AD-1019491 | 37.54 | 2.60 | 38.78 | 4.86 | 61.14 | 10.96 | 84.32 | 10.33 |

TABLE 31

| HTT Single Dose Screens in BE(2)C Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1255829.1 | 42.96 | 5.68 | 43.85 | 2.29 | 66.98 | 1.37 | 87.40 | 4.66 |
| AD-1289804.1 | 51.24 | 11.22 | 49.88 | 3.32 | 74.10 | 3.11 | 112.44 | 7.55 |
| AD-1255847.1 | 56.33 | 5.48 | 53.42 | 4.55 | 73.16 | 9.69 | 86.04 | 11.02 |
| AD-1255846.1 | 60.91 | 8.58 | 54.43 | 5.62 | 76.71 | 5.58 | 88.90 | 9.21 |
| AD-1255842.1 | 71.67 | 8.66 | 57.02 | 6.91 | 82.51 | 3.37 | 88.66 | 8.57 |
| AD-1255826.1 | 63.03 | 13.87 | 61.10 | 6.07 | 81.42 | 7.45 | 106.67 | 5.54 |
| AD-1255828.1 | 58.25 | 8.33 | 61.99 | 2.58 | 62.19 | 9.96 | 95.71 | 14.52 |
| AD-1255844.1 | 77.81 | 19.83 | 62.45 | 3.32 | 93.71 | 5.93 | 94.62 | 11.51 |
| AD-1289792.1 | 63.07 | 19.66 | 62.71 | 7.40 | 70.83 | 2.95 | 97.30 | 8.23 |
| AD-1255825.1 | 61.98 | 11.14 | 62.99 | 5.30 | 82.22 | 8.57 | 113.33 | 9.73 |
| AD-1255822.1 | 54.95 | 8.25 | 63.21 | 7.99 | 73.10 | 6.20 | 94.27 | 7.33 |
| AD-1255839.1 | 79.41 | 19.00 | 63.82 | 10.25 | 78.93 | 6.77 | 92.85 | 7.99 |
| AD-1255827.1 | 66.37 | 7.51 | 66.77 | 10.38 | 76.46 | 6.28 | 93.56 | 8.78 |
| AD-1255824.1 | 70.91 | 12.73 | 67.84 | 12.01 | 79.52 | 3.88 | 104.18 | 6.96 |
| AD-1255845.1 | 71.58 | 5.96 | 68.53 | 5.24 | 99.80 | 7.33 | 102.28 | 15.66 |
| AD-1255830.1 | 55.81 | 5.08 | 72.00 | 4.27 | 85.56 | 3.31 | 107.28 | 6.84 |
| AD-1289806.1 | 73.43 | 5.18 | 76.80 | 10.37 | 92.52 | 7.68 | 102.29 | 4.29 |
| AD-1255836.1 | 124.80 | 23.77 | 81.79 | 12.98 | 107.34 | 3.39 | 93.98 | 7.73 |
| AD-1289807.1 | 77.24 | 10.72 | 87.68 | 14.15 | 82.46 | 0.99 | 99.67 | 4.22 |
| AD-1289805.1 | 88.02 | 4.90 | 90.31 | 4.52 | 97.27 | 3.91 | 121.40 | 4.20 |
| AD-1255840.1 | 105.83 | 14.38 | 90.46 | 4.13 | 80.88 | 15.34 | 82.60 | 12.65 |
| AD-1289808.1 | 122.86 | 14.70 | 92.14 | 2.12 | 102.50 | 3.56 | 96.30 | 8.50 |
| AD-1289800.1 | 76.52 | 4.81 | 93.52 | 5.12 | 90.00 | 4.51 | 95.56 | 2.21 |
| AD-1255838.1 | 89.17 | 8.94 | 93.90 | 18.11 | 108.49 | 11.18 | 94.09 | 9.61 |
| AD-1255843.1 | 107.35 | 9.98 | 93.92 | 6.81 | 109.57 | 7.77 | 93.99 | 4.85 |
| AD-1255837.1 | 117.27 | 34.77 | 93.96 | 7.45 | 98.71 | 18.19 | 100.51 | 7.76 |
| AD-1255833.1 | 99.27 | 6.98 | 94.69 | 17.28 | 101.75 | 10.49 | 88.41 | 2.89 |

TABLE 31-continued

| HTT Single Dose Screens in BE(2)C Cells | | | | | | | | |
|---|---|---|---|---|---|---|---|---|
| | 50 nM Dose | | 10 nM Dose | | 1 nM Dose | | 0.1 nM Dose | |
| Duplex | Avg % HTT mRNA remaining | SD | Avg % HTT mRNA remaining | SD | Avg % HTT mRNA remaining | SD | Avg % HTT mRNA remaining | SD |
| AD-1289797.1 | 80.55 | 6.78 | 98.81 | 6.21 | 74.29 | 18.16 | 104.59 | 7.71 |
| AD-1255823.1 | 105.66 | 24.48 | 98.93 | 13.66 | 86.06 | 9.79 | 100.05 | 8.60 |
| AD-1289810.1 | 92.87 | 20.76 | 100.62 | 6.60 | 97.46 | 4.56 | 122.30 | 16.77 |
| AD-1289811.1 | 93.41 | 6.43 | 102.94 | 1.79 | 96.52 | 6.13 | 98.20 | 6.21 |
| AD-1289812.1 | 90.48 | 4.72 | 104.24 | 15.15 | 83.21 | 3.00 | 96.73 | 22.75 |
| AD-1255841.1 | 101.07 | 13.00 | 104.75 | 7.36 | 100.13 | 18.24 | 96.25 | 9.73 |
| AD-1289799.1 | 91.60 | 17.43 | 104.76 | 10.87 | 85.06 | 17.47 | 85.10 | 10.35 |
| AD-1255834.1 | 125.74 | 10.44 | 106.54 | 6.84 | 94.34 | 21.58 | 97.11 | 4.22 |
| AD-1289809.1 | 124.27 | 17.95 | 108.22 | 12.24 | 99.43 | 0.97 | 103.04 | 5.39 |
| AD-1289801.1 | 98.11 | 7.63 | 109.29 | 5.74 | 98.62 | 7.63 | 111.41 | 15.08 |
| AD-1289793.1 | 98.72 | 9.25 | 110.46 | 9.91 | 116.62 | 26.19 | 103.92 | 5.03 |
| AD-1289798.1 | 94.79 | 16.26 | 110.50 | 7.33 | 88.92 | 11.12 | 104.76 | 15.05 |
| AD-1289796.1 | 81.94 | 6.56 | 110.65 | 15.00 | 87.24 | 7.53 | 121.12 | 19.77 |
| AD-1289803.1 | 109.67 | 9.57 | 115.61 | 26.44 | 88.09 | 26.87 | 110.34 | 2.77 |
| AD-1255835.1 | 97.25 | 6.52 | 116.18 | 25.86 | 102.10 | 12.39 | 101.26 | 5.04 |
| AD-1289802.1 | 99.88 | 5.45 | 122.93 | 13.24 | 98.52 | 8.59 | 115.30 | 12.06 |
| AD-1289794.1 | 86.59 | 6.59 | 130.53 | 22.85 | 95.85 | 8.83 | 118.93 | 12.22 |
| AD-1289795.1 | 92.81 | 12.98 | 132.84 | 25.18 | 101.37 | 16.37 | 108.22 | 9.88 |

TABLE 34

| HTT Single Dose Screens in BE(2)C Cells | | | | | | | | |
|---|---|---|---|---|---|---|---|---|
| | 50 nM | | 10 nM | | 1 nM | | 0.1 nM | |
| Duplex | Avg | SD | Avg | SD | Avg | SD | Avg | SD |
| AD-1289928.1 | 26.86 | 1.60 | 19.55 | 4.52 | 22.39 | 2.15 | 24.14 | 1.37 |
| AD-1289833.1 | 23.91 | 3.07 | 17.68 | 4.58 | 23.55 | 2.74 | 27.27 | 2.74 |
| AD-1289929.1 | 23.77 | 2.47 | 15.37 | 2.70 | 24.10 | 4.62 | 24.65 | 2.18 |
| AD-1289927.1 | 27.09 | 5.65 | 18.06 | 2.62 | 24.84 | 1.66 | 28.64 | 2.32 |
| AD-1289826.1 | 25.34 | 2.46 | 16.35 | 1.53 | 25.52 | 5.56 | 25.98 | 2.57 |
| AD-1289831.1 | 30.21 | 1.67 | 36.35 | 7.86 | 26.09 | 3.74 | 30.90 | 2.30 |
| AD-1289925.1 | 25.68 | 4.12 | 20.60 | 4.16 | 27.36 | 3.07 | 39.34 | 7.40 |
| AD-1289824.1 | 32.57 | 4.27 | 38.34 | 6.20 | 29.00 | 2.92 | 34.38 | 5.30 |
| AD-1289832.1 | 32.44 | 3.57 | 35.65 | 5.85 | 29.89 | 2.64 | 37.93 | 10.68 |
| AD-1289825.1 | 39.83 | 17.90 | 26.65 | 9.54 | 30.69 | 2.01 | 34.00 | 4.25 |
| AD-1289852.1 | 29.07 | 4.82 | 35.54 | 5.97 | 30.92 | 7.56 | 49.11 | 2.59 |
| AD-1289867.1 | 28.36 | 2.80 | 31.88 | 7.37 | 31.98 | 12.26 | 56.00 | 5.83 |
| AD-1289924.1 | 26.70 | 1.03 | 24.41 | 1.78 | 32.66 | 3.15 | 39.48 | 5.92 |
| AD-1289853.1 | 34.66 | 4.96 | 28.99 | 3.10 | 35.62 | 5.35 | 47.55 | 8.03 |
| AD-1289860.1 | 30.85 | 1.81 | 33.63 | 6.59 | 36.85 | 9.35 | 47.87 | 13.74 |
| AD-1289931.1 | 27.24 | 1.71 | 29.84 | 4.12 | 36.93 | 5.95 | 52.53 | 23.19 |
| AD-1289926.1 | 20.74 | 1.73 | 21.36 | 3.76 | 37.21 | 10.19 | 33.30 | 5.90 |
| AD-1289851.1 | 29.04 | 4.65 | 46.37 | 10.68 | 37.41 | 7.70 | 59.15 | 8.97 |
| AD-1289930.1 | 28.14 | 3.09 | 27.85 | 5.73 | 37.82 | 7.73 | 51.47 | 21.21 |
| AD-1289859.1 | 32.10 | 2.80 | 36.95 | 3.88 | 39.64 | 2.26 | 51.16 | 3.87 |
| AD-1289932.1 | 38.64 | 15.28 | 32.51 | 2.70 | 40.87 | 5.61 | 57.50 | 9.85 |
| AD-1019405.3 | 32.37 | 3.41 | 27.02 | 4.04 | 40.92 | 2.74 | 27.48 | 2.39 |
| AD-1289861.1 | 28.13 | 4.06 | 21.27 | 3.46 | 41.31 | 5.09 | 49.50 | 12.59 |
| AD-1107447.5 | 37.70 | 10.79 | 43.44 | 9.88 | 41.46 | 7.19 | 49.31 | 3.36 |
| AD-1289948.1 | 30.97 | 2.76 | 40.28 | 4.17 | 41.80 | 7.23 | 66.69 | 15.51 |
| AD-1289864.1 | 29.78 | 3.77 | 39.21 | 7.89 | 42.69 | 5.07 | 89.93 | 14.78 |
| AD-1289913.1 | 31.72 | 5.80 | 34.84 | 8.88 | 42.95 | 10.68 | 73.21 | 7.08 |
| AD-1289923.1 | 59.24 | 10.74 | 39.10 | 6.46 | 45.24 | 7.48 | 32.36 | 10.02 |
| AD-1289921.1 | 53.68 | 1.92 | 58.15 | 6.99 | 45.73 | 4.52 | 65.30 | 17.40 |
| AD-1289865.1 | 31.87 | 5.72 | 40.91 | 4.15 | 45.75 | 10.10 | 79.13 | 17.89 |
| AD-1107442.5 | 32.33 | 6.49 | 43.54 | 11.06 | 46.70 | 8.32 | 64.81 | 14.58 |
| AD-1289830.1 | 42.03 | 13.79 | 33.46 | 8.03 | 46.86 | 4.86 | 59.66 | 10.81 |
| AD-1289866.1 | 36.51 | 6.26 | 41.19 | 8.95 | 46.89 | 11.53 | 71.88 | 7.53 |
| AD-1289947.1 | 38.31 | 1.99 | 49.21 | 5.64 | 48.00 | 8.18 | 83.10 | 17.67 |
| AD-1289933.1 | 32.81 | 4.00 | 35.67 | 2.53 | 48.04 | 7.15 | 69.06 | 9.73 |
| AD-1289950.1 | 27.26 | 3.33 | 34.49 | 6.62 | 48.53 | 8.09 | 69.57 | 3.80 |
| AD-1289868.1 | 30.84 | 5.79 | 42.94 | 4.23 | 52.80 | 8.22 | 61.31 | 3.51 |
| AD-1289946.1 | 46.68 | 5.83 | 46.28 | 8.49 | 54.50 | 7.35 | 68.13 | 7.41 |
| AD-1289960.1 | 35.30 | 1.65 | 35.68 | 3.55 | 54.94 | 9.28 | 65.79 | 5.26 |
| AD-1289956.1 | 27.84 | 2.18 | 36.44 | 6.74 | 55.13 | 12.30 | 71.89 | 7.68 |
| AD-1289827.1 | 28.82 | 5.84 | 29.88 | 4.99 | 55.28 | 10.84 | 52.68 | 11.79 |

TABLE 34-continued

| HTT Single Dose Screens in BE(2)C Cells | | | | | | | | |
|---|---|---|---|---|---|---|---|---|
| | 50 nM | | 10 nM | | 1 nM | | 0.1 nM | |
| Duplex | Avg | SD | Avg | SD | Avg | SD | Avg | SD |
| AD-1289829.1 | 40.71 | 2.43 | 53.32 | 13.95 | 56.16 | 7.42 | 85.09 | 20.29 |
| AD-1289850.1 | 68.59 | 4.01 | 72.52 | 15.97 | 58.55 | 10.21 | 83.76 | 7.50 |
| AD-1289945.1 | 59.40 | 11.93 | 40.74 | 8.64 | 59.54 | 12.43 | 76.72 | 22.59 |
| AD-1289835.1 | 37.25 | 4.53 | 52.77 | 8.52 | 60.32 | 12.83 | 112.64 | 25.83 |
| AD-1289828.1 | 39.08 | 9.24 | 50.27 | 6.14 | 60.38 | 8.94 | 85.28 | 13.09 |
| AD-1289949.1 | 48.48 | 15.67 | 46.75 | 6.41 | 60.71 | 7.90 | 74.31 | 4.00 |
| AD-1289871.1 | 31.65 | 7.54 | 50.42 | 4.81 | 60.78 | 10.75 | 76.82 | 20.33 |
| AD-1289914.1 | 31.82 | 1.51 | 36.43 | 2.73 | 60.93 | 9.49 | 76.70 | 18.34 |
| AD-1289911.1 | 36.55 | 3.76 | 52.21 | 4.79 | 61.12 | 6.82 | 96.29 | 13.51 |
| AD-1289857.1 | 37.65 | 1.30 | 54.22 | 7.43 | 62.08 | 12.37 | 112.67 | 7.11 |
| AD-1289944.1 | 41.93 | 6.76 | 38.97 | 6.75 | 62.30 | 6.63 | 103.47 | 5.76 |
| AD-1289957.1 | 28.01 | 4.91 | 33.18 | 4.70 | 63.87 | 9.58 | 81.23 | 11.07 |
| AD-1289955.1 | 35.33 | 2.36 | 39.61 | 7.12 | 64.57 | 6.39 | 83.55 | 12.05 |
| AD-1289834.1 | 38.03 | 15.96 | 41.29 | 5.72 | 66.11 | 14.38 | 70.25 | 14.42 |
| AD-1289855.1 | 47.03 | 10.61 | 45.38 | 6.17 | 66.56 | 9.83 | 113.47 | 25.72 |
| AD-1019402.3 | 51.50 | 11.45 | 78.69 | 14.18 | 67.31 | 12.68 | 108.20 | 11.66 |
| AD-1289954.1 | 53.07 | 5.81 | 56.54 | 15.91 | 69.08 | 10.97 | 81.29 | 11.70 |
| AD-1289920.1 | 59.99 | 6.29 | 76.06 | 5.44 | 72.04 | 7.85 | 83.88 | 18.77 |
| AD-1019426.3 | 35.72 | 4.46 | 39.52 | 5.34 | 72.10 | 11.86 | 105.24 | 4.97 |
| AD-1289862.1 | 35.67 | 5.88 | 38.24 | 6.53 | 72.61 | 22.46 | 94.79 | 2.43 |
| AD-1289854.1 | 49.03 | 11.42 | 48.86 | 5.36 | 73.01 | 13.83 | 88.95 | 28.52 |
| AD-1289914.2 | 30.03 | 5.23 | 33.37 | 2.93 | 73.79 | 12.67 | 88.84 | 7.72 |
| AD-1289915.1 | 51.74 | 11.74 | 41.21 | 11.76 | 74.00 | 18.84 | 103.91 | 17.51 |
| AD-1107449.5 | 41.89 | 7.53 | 42.32 | 2.51 | 74.27 | 4.96 | 117.23 | 13.14 |
| AD-1289870.1 | 48.95 | 10.27 | 49.15 | 12.60 | 74.52 | 14.88 | 105.14 | 20.17 |
| AD-1289953.1 | 35.31 | 3.01 | 45.74 | 4.87 | 74.71 | 7.89 | 107.34 | 16.59 |
| AD-1107451.5 | 48.67 | 4.47 | 55.46 | 6.57 | 76.65 | 14.88 | 114.80 | 16.96 |
| AD-1289961.1 | 52.85 | 13.96 | 49.17 | 9.57 | 77.13 | 6.98 | 84.90 | 17.73 |
| AD-1289951.1 | 31.47 | 8.60 | 45.99 | 5.14 | 77.78 | 9.98 | 102.83 | 16.18 |
| AD-1289915.2 | 37.75 | 9.20 | 40.82 | 2.69 | 79.15 | 10.39 | 99.07 | 23.10 |
| AD-1289912.1 | 82.10 | 12.60 | 95.77 | 23.45 | 79.51 | 11.95 | 88.10 | 11.79 |
| AD-1289958.1 | 49.85 | 10.86 | 43.74 | 4.02 | 79.96 | 21.58 | 106.79 | 13.72 |
| AD-1289869.1 | 41.54 | 14.67 | 48.99 | 10.01 | 81.83 | 10.93 | 95.34 | 11.88 |
| AD-1289916.2 | 38.11 | 12.11 | 30.92 | 6.77 | 83.06 | 27.70 | 89.95 | 11.93 |
| AD-1289858.1 | 77.51 | 8.31 | 98.31 | 11.66 | 83.94 | 4.52 | 88.77 | 13.74 |
| AD-1289789.1 | 57.63 | 5.94 | 59.15 | 10.78 | 86.59 | 17.72 | 91.84 | 14.11 |
| AD-1255821.1 | 69.16 | 8.85 | 82.13 | 11.58 | 89.11 | 12.53 | 97.77 | 12.97 |
| AD-1289959.1 | 42.26 | 5.22 | 40.42 | 4.96 | 90.44 | 16.55 | 71.09 | 18.49 |
| AD-1289790.1 | 73.58 | 9.37 | 78.35 | 21.25 | 90.71 | 28.57 | 82.85 | 26.71 |
| AD-1289952.1 | 52.77 | 12.63 | 56.28 | 12.30 | 94.30 | 5.79 | 131.73 | 12.58 |
| AD-1289791.1 | 74.62 | 17.99 | 119.43 | 34.26 | 99.39 | 20.30 | 98.65 | 23.07 |
| AD-1289922.1 | 83.30 | 14.91 | 69.35 | 9.41 | 100.96 | 15.26 | 98.87 | 18.45 |
| AD-1289919.1 | 84.61 | 7.92 | 93.30 | 16.27 | 100.99 | 12.77 | 98.84 | 16.16 |
| AD-1289916.1 | 51.67 | 8.05 | 54.39 | 2.65 | 102.21 | 17.34 | 146.47 | 25.74 |
| AD-1289863.1 | 96.63 | 15.42 | 129.19 | 8.00 | 146.62 | 21.26 | 154.53 | 20.81 |

Example 2. HTT In Vivo Screen Using RNAi Agents Targeting HTT Exon1—AAV

Duplexes of interest targeting HTT exon 1, identified from the above in vitro studies, were evaluated in vivo.

In particular, at pre-dose day −14 wild-type mice (C57BL/6) were transduced by retroorbital administration of $2\times10^{10}$ viral particles of an adeno-associated virus 8 (AAV8) vector encoding a portion of wild type human HTT. Exemplary AAV vectors are provided in the Table below.

| Construct | Region | Start | End | Insert (bp) | Length (bp) |
|---|---|---|---|---|---|
| AAV1 | 5' UTR + ORF | 1 | 2655 | 200 | 2855 |
| AAV2 | ORF | 2656 | 5310 | 200 | 2855 |
| AAV3 | ORF | 5311 | 7965 | 200 | 2855 |
| AAV4 | ORF + 3'UTR | 7966 | 10820 | — | 2855 |
| AAV5 | 3'UTR | 10821 | 13475 | 200 | 2855 |

In this experiment, mice were administered an AAV8 encoding a portion of wild-type HTT (AAV1).

Figure 1:
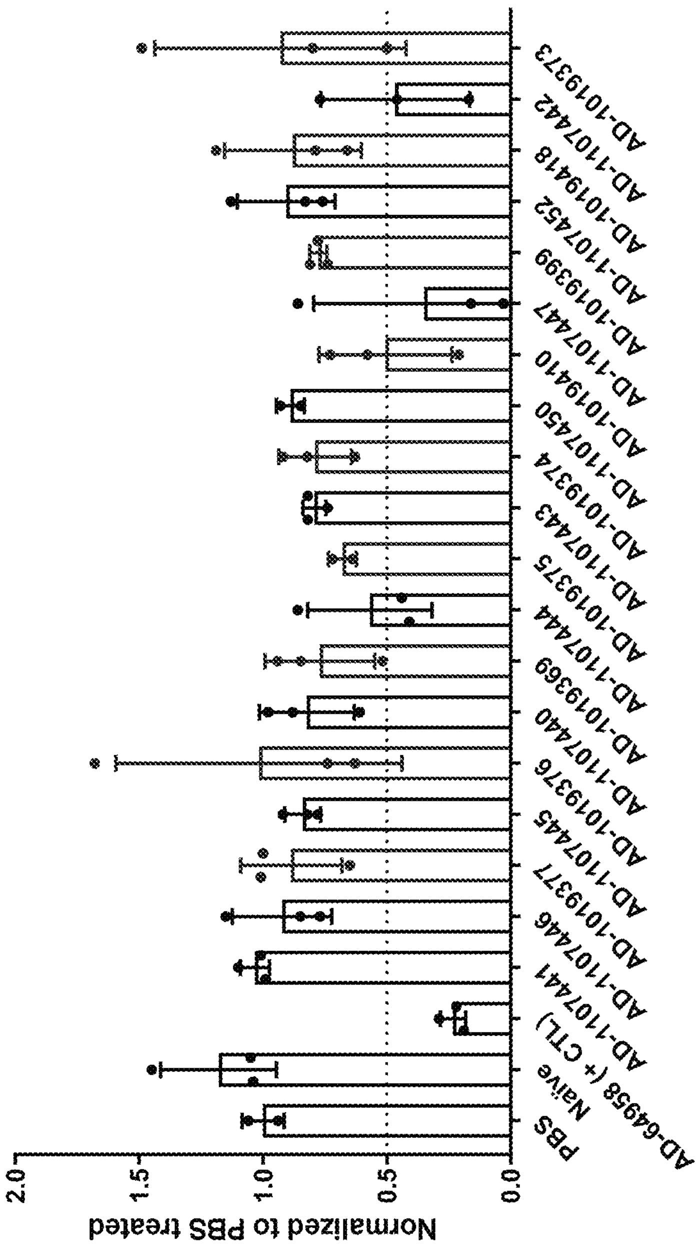
Figure 2:
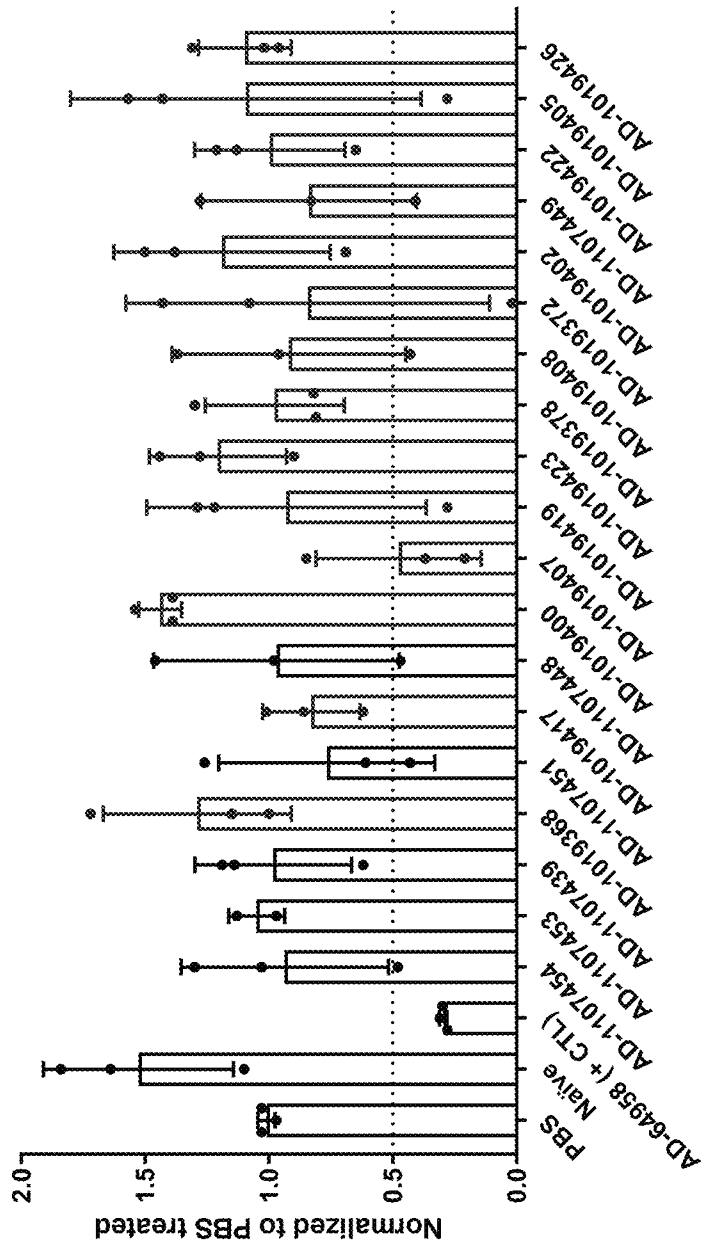

At day 0, groups of three mice were subcutaneously administered a single 3 mg/kg dose of the agents of interest or PBS control. At day 14 post-dose animals were sacrificed, liver samples were collected and snap-frozen in liquid nitrogen. Tissue mRNA was extracted and analyzed by the RT-QPCR method. Human HTT mRNA levels were compared to housekeeping gene GAPDH. The values were then normalized to the average of AAV control group. The data were expressed as percent of baseline value, and presented as mean±standard deviation. The results, shown in FIGS. 1 and 2, demonstrate that the exemplary duplex agents tested effectively reduce the level of the human HTT messenger RNA in vivo.

Example 3. HTT In Vivo Screen with RNAi Agents Targeting HTT Exon1

Duplexes of interest targeting exon 1 of human HTT were evaluated in an art-recognized mouse model of Huntington disease (HD), the YAC128 mouse model of HD. YAC128 mice harbor a yeast artificial chromosome (YAC) containing the entire human HD gene containing 128 CAG repeats in their genomes. YAC128 mice develop motor abnormalities and age-dependent brain atrophy including cortical and striatal atrophy associated with striatal neuronal loss. YAC128 mice exhibit initial hyperactivity, followed by the onset of a motor deficit and finally hypokinesis (see, e.g., Slow, et al. (2003) *Human Molecular Genetics* 12(13):1555; Van Raamsdonk, et al. (2005), 2 *Human Molecular Genetics* 14(24):3823; and Carroll, et al. (2011) *Neurobiology of Disease* 43:257-265).

At Day 0, YAC128 mice (7-13 weeks of age, 27.7±3.4 grams, n=36) were subcutaneously administered a single 10 mg/kg dose of the agents of interest or PBS control. At day 7 post-dose, animals were sacrificed, liver samples were collected and snap-frozen in liquid nitrogen. Liver mRNA was extracted and analyzed by the RT-QPCR method.

Figure 3B:
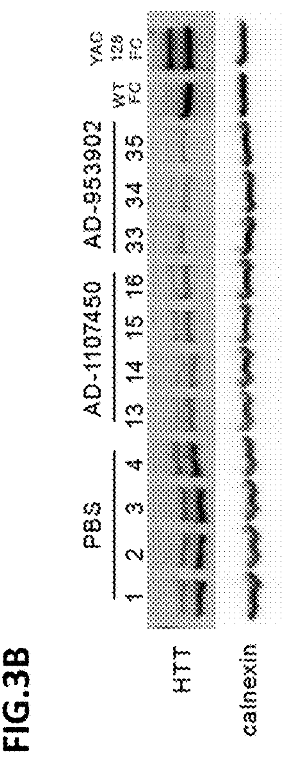
FIG. 3B is a Western Blot showing mutant human HTT protein and wildtype mouse HTT protein levels in the livers of YAC128 mice, subcutaneously administered a single 10 mg/kg dose of the indicated dsRNA duplexes targeting exon 1 of the human HTT transcript at Day 7 post-dose.
Figure 3C:
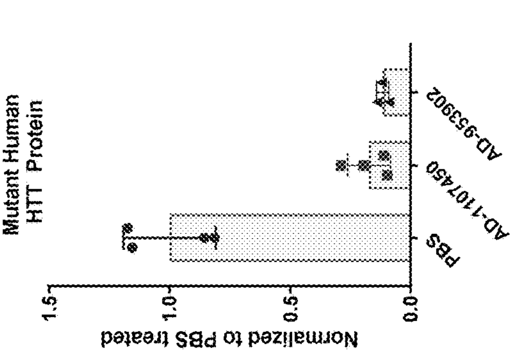
FIG. 3C is a bar graph showing mutant human HTT protein levels in the livers of YAC128 mice subcutaneously administered a single 10 mg/kg dose of the indicated dsRNA duplexes targeting exon 1 of the human HTT transcript at Day 7 post-dose. Mutant human HTT levels shown are normalized to PBS treatment levels.
Figure 3A:
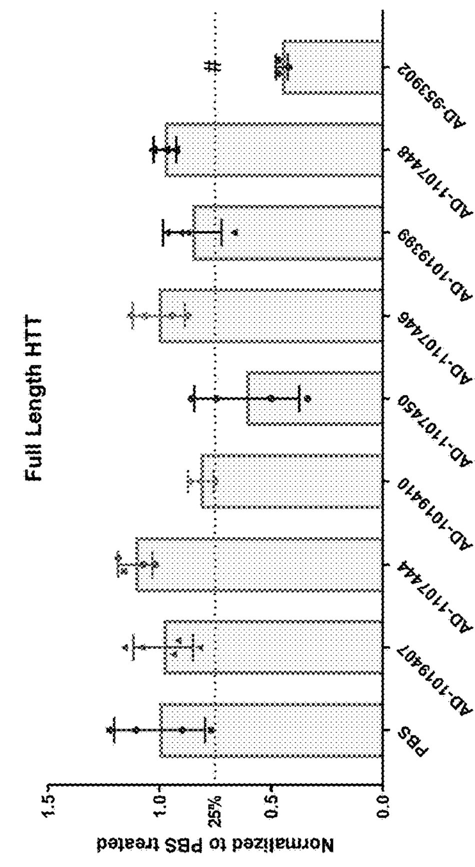
FIG. 3A is a graph showing full length mutant human HTT mRNA levels in the livers of YAC128 mice and subcutaneously administered a single 10 mg/kg dose of the indicated dsRNA duplexes targeting exon 1 of the human HTT transcript at Day 7 post-dose. Human HTT levels shown are normalized to PBS treatment levels.

The effect of these agent on full-length wild-type human HTT mRNA is shown in FIG. 3A. These data demonstrate that the exemplary duplex agents tested effectively reduce the level of the human HTT messenger RNA in vivo.

Human mutant HTT protein levels were determined using Western Blot analysis.

Briefly, livers were homogenized in RIPA buffer along with protease inhibitors. Total protein was quantified using Pierce BCA kit following manufacturer's instructions. Eighty μg of total cell lysates were denatured by boiling in 4×LDS buffer and were subjected to SDS-PAGE in a 3-8% tris acetate gradient gel and transferred to PVDF membranes. The blots were blocked with Odyssey blocking buffer for 1 hour at room temperature and hybridized to specific antibodies overnight at 4° C. The following antibodies were used: HTT (Millipore, Catalog #MAB2166), Calnexin (Millipore-Sigma, catalog #C4731, Fluorescence conjugated secondary antibodies (Licor, Goat anti-rabbit, Catalog #926-32211 and Donkey anti-mouse, Catalog #926-680721:5000). Detection of protein bands was carried out using the Biorad Chemidoc MP Imaging system. The density of each HTT band was normalized to Calnexin loading control and the normalized intensities were used to quantify HTT knockdown in siRNA treated samples relative to vehicle (1×PBS) treated controls.

The effect of these agents on mutant human HTT protein levels is shown in FIGS. 3B-3C. These data demonstrate that the exemplary duplex agents tested effectively reduce the level of the full-length wild-type human HTT messenger RNA (FIG. 3A) as well as mutant human HTT protein in vivo.

Figure 4A:
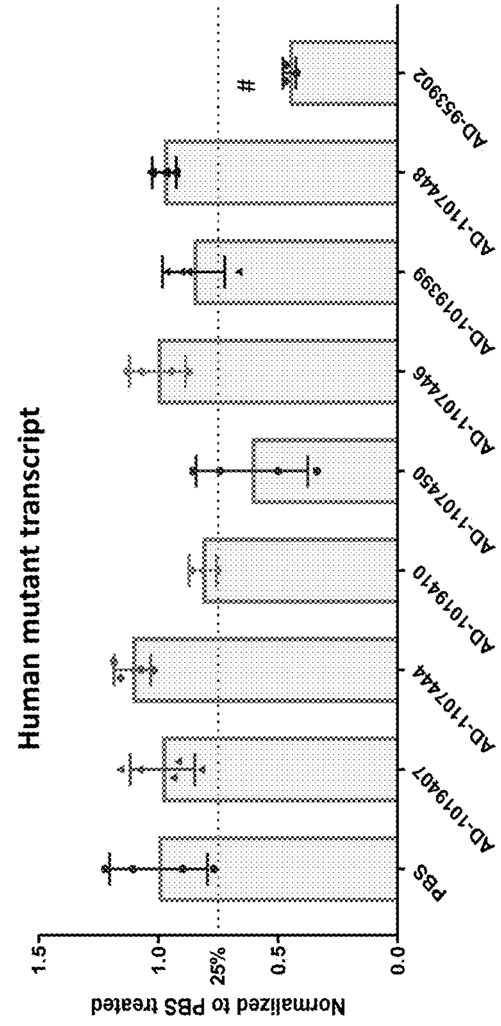
FIG. 4A is a graph showing full-length mutant HTT mRNA levels in the livers of YAC128 mice subcutaneously administered a single 10 mg/kg dose of the indicated dsRNA duplexes targeting exon 1 of the HTT transcript at Day 7 post-dose. Full-length mutant human HTT levels shown are normalized to PBS treatment levels.
Figure 4B:
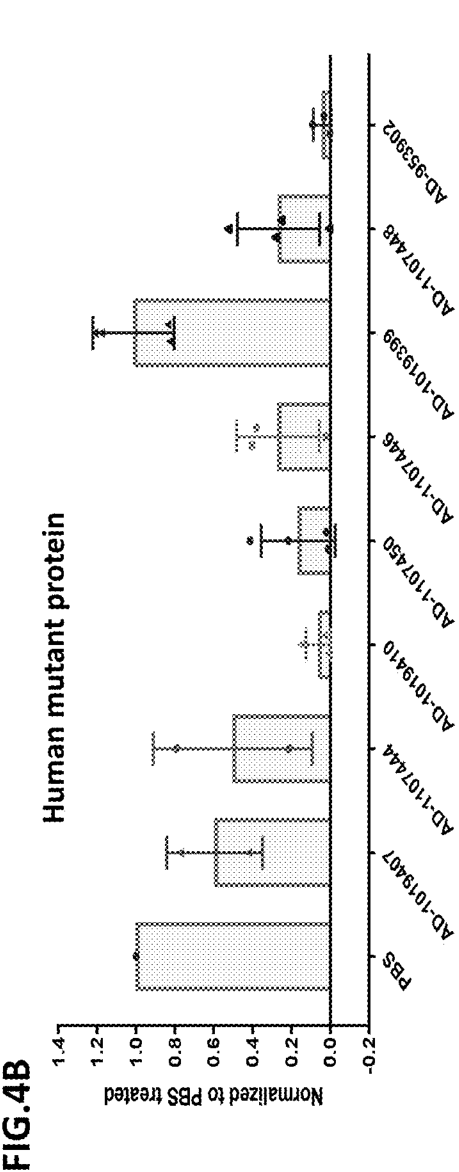
FIG. 4B is a bar graph showing quantification of mutant HTT protein levels in the livers of YAC128 mice subcutaneously administered a single 10 mg/kg dose of the indicated dsRNA duplexes targeting exon 1 of the HTT transcript at Day 7 post-dose. Mutant human HTT levels shown are normalized to PBS treatment levels.

In another set of experiments, YAC128 mice (7-13 weeks of age, 27.7±3.4 grams, n=36) were subcutaneously administered a single 10 mg/kg dose of the agents of interest or PBS control at Day 0. At day 7 post-dose, animals were sacrificed, liver samples were collected and snap-frozen in liquid nitrogen. Liver mRNA was extracted and analyzed by the RT-QPCR method. Full-length mutant HTT mRNA levels and full-length mutant HTT protein levels were analyzed as described above. The results are shown in FIGS. 4A-4B and demonstrate that the exemplary duplex agents tested effectively reduce the level of the mutant human HTT protein in vivo.

Additional duplexes of interest targeting exon 1 of human HTT were also assessed for the ability to inhibit human full-length wild-type HTT expression in vivo in mice of varying ages and weights. Specifically, at Day 0, mice (10-16 week of age, 28.2±3.7 grams, n=84) were subcutaneously administered a single 10 mg/kg dose of the agents of interest or PBS control. At day 7 post-dose, animals were sacrificed, liver samples were collected and snap-frozen in liquid nitrogen. Liver mRNA was extracted and analyzed by the RT-QPCR method.

Figure 5:
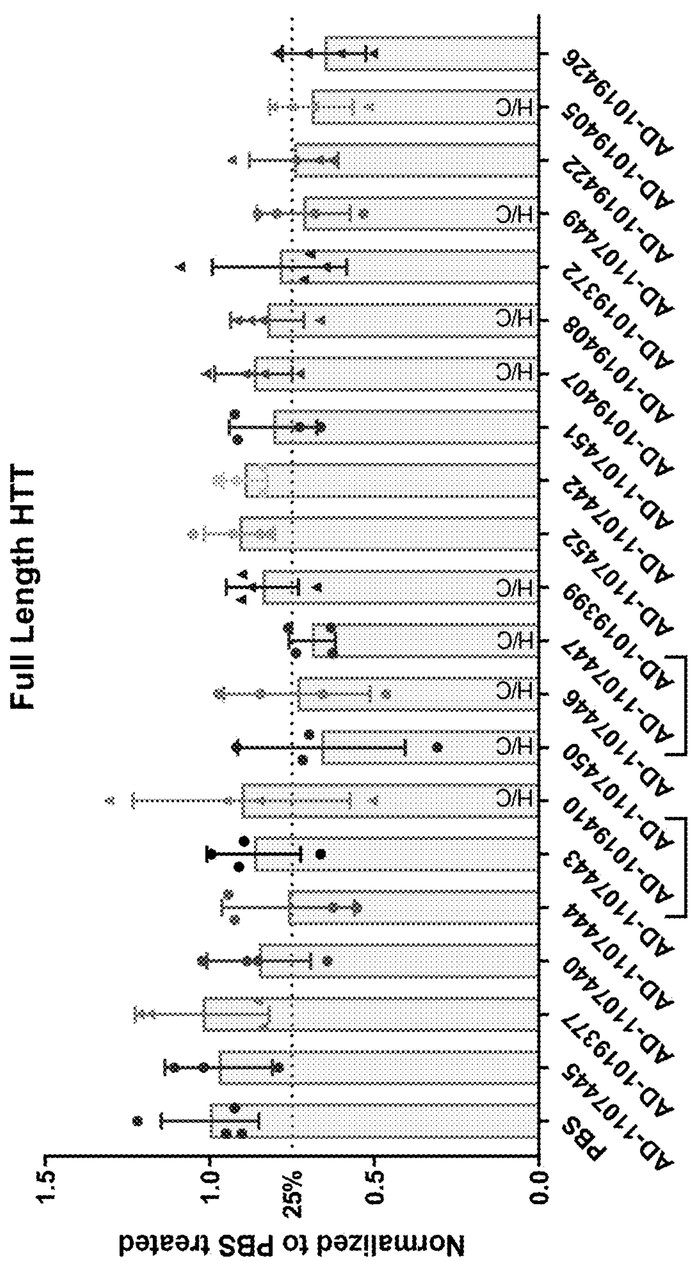
FIG. 5 is a graph showing full-length mutant human HTT mRNA levels in the livers of YAC128 mice subcutaneously administered a single 10 mg/kg dose of the indicated dsRNA duplexes targeting exon 1 of the HTT transcript at Day 7 post-dose. Human HTT levels shown are normalized to PBS treatment levels.

Full-length wild-type human HTT mRNA levels were measured as described herein, and the results are shown in FIG. 5 and demonstrate that the exemplary duplex agents tested effectively reduce the level of the full-length wild-type human HTT mRNA in vivo.

Example 4. Structural Activity Relationship Analysis

Duplexes of interest targeting exon 1 of human HTT were selected for further structural activity relationship (SAR) analysis and assessed for the ability to inhibit mutant HTT expression in vivo.

Specifically, at Day 0, YAC128 mice (6-9 weeks of age, n=4 per group) were subcutaneously administered a single 10 mg/kg dose of the agents of interest or PBS control. At day 7 post-dose, animals were sacrificed, liver samples were collected and snap-frozen in liquid nitrogen. Liver mRNA was extracted and analyzed by the RT-QPCR method.

FIG. 6 shows the effect of these agents on full-length mutant human HTT mRNA levels and full-length mutant human protein levels. The data demonstrate that the agents inhibit expression of mutant exon 1 of human HTT and full-length mutant human HTT mRNA and full-length human protein in vivo.

Additional duplexes of interest were also assessed in YAC128 mice (6 weeks of age, n=4 per group). At Day 0, mice were subcutaneously administered a single 10 mg/kg dose of the agents of interest or PBS control. At day 7 post-dose, animals were sacrificed, liver samples were collected and snap-frozen in liquid nitrogen. Liver mRNA was extracted and analyzed by the RT-QPCR method.

Figure 7:
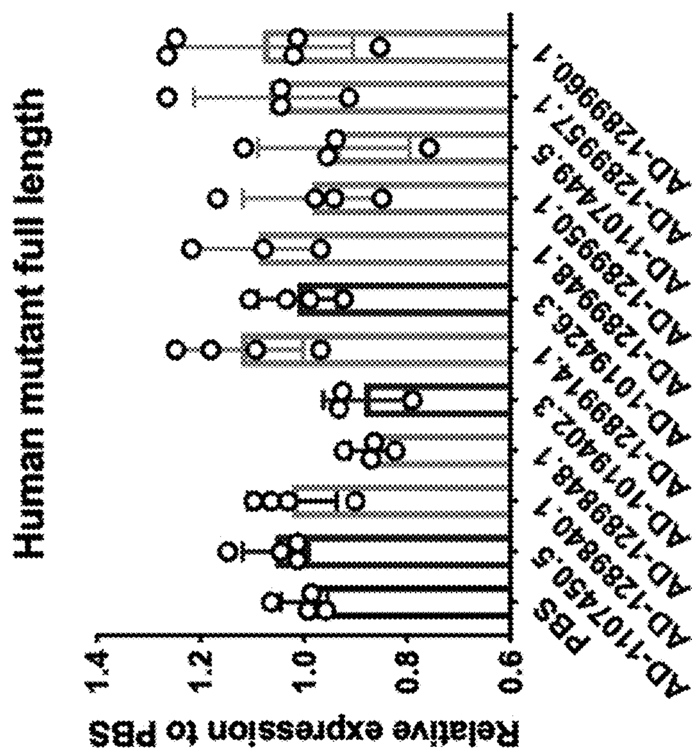
FIG. 7 is a graph showing mutant full-length human HTT mRNA levels in YAC128 mice subcutaneously administered a single 10 mg/kg dose of the indicated dsRNA duplexes at Day 7 post-dose. Mutant human HTT levels shown are normalized to PBS treatment levels.

FIG. 7 shows the effect of these agents on full-length mutant human HTT mRNA levels.

Example 5. In Vitro Screen in Human HD Patient Fibroblasts

The effect of duplexes of interest on the expression of full-length wild type human HTT and full-length mutant HTT was also assessed in human fibroblasts. Fibroblasts were obtained from Coriell, adult healthy control patient ("Control", GM02153), an HD patient with adult disease onset ("Adult", GM04478") and an HD patient with juvenile disease onset ("Juvenile", GM09197"). Fibroblasts were transfected with either 10 nM or 50 nM of duplexes targeting exon 1 of the HTT gene or the full length HTT gene.

The results are shown in FIGS. 8A-8B, FIGS. 9A-9B, FIGS. 10A-10D and FIGS. 11A-11D and demonstrate that the agents targeting exon 1 of the HTT gene or the full length HTT gene inhibit expression of the full-length mutant human HTT mRNA in patient samples in vitro.

Example 6. HTT In Vivo Screen with RNAi Agents Targeting Full Length Human HTT Duplexes of interest targeting full length human HTT, identified from the above in vitro studies, were evaluated in vivo using both the YAC128 mouse model and the AAV approaches, as described herein.

At pre-dose day −14 wild-type mice (C57BL/6, 7-13 weeks of age, 27.7±3.4 grams, n=36) were transduced by retro-orbital administration of $2\times10^{10}$ viral particles of an adeno-associated virus 8 (AAV8) vector encoding a portion of human HTT, including AAV1, AAV2, AAV3, or AAV4, as described in Example 2 above.

At Day 0, the transduced mice and YAC128 mice were subcutaneously administered a single 3 mg/kg or a 10 mg/kg dose of the agents of interest or PBS control. At Day 7 or Day 14 post-dose, animals were sacrificed, liver samples were collected and snap-frozen in liquid nitrogen. Liver mRNA was extracted and analyzed by the RT-QPCR method.

As shown in FIG. 12, the agents inhibit expression of full-length human HTT or full-length mutant human HTT mRNA in vivo using both experimental models.

Additional duplexes of interest targeting full-length human HTT were also assessed for their ability to inhibit wild-type human HTT in vivo.

At pre-dose day −14 wild-type mice (C57BL/6, 7-13 weeks of age, 27.7±3.4 grams, n=36) were transduced by intravenous administration of $2\times10^{10}$ viral particles of AAV1, AAV2, AAV3, or AAV4 (see Table above in Example 2).

At Day 0, the transduced mice were subcutaneously administered a single 3 mg/kg dose of the agents of interest or PBS control. At Day 14 post-dose, animals were sacrificed, liver samples were collected and snap-frozen in liquid nitrogen. Liver mRNA was extracted and analyzed by the RT-QPCR method.

As shown in FIGS. 13A-13D, the agents inhibit expression of full-length wild-type human HTT mRNA in vivo and numerous duplexes targeting full-length human HTT transcript were determined to have an efficacy of greater than 90%.

SEQUENCE LISTING (4491 sequences)

SEQ ID NO: 1 - DNA, 13498 bp, Homo sapiens
gctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctaaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcaaaaaaaaaaaaaaaaaa

SEQ ID NO: 2 - DNA, 13237 bp, Mus musculus
gcactcgccgcgagggttgccgggacgggcccaagatggctgagcgccttggttccgcttctgcctgccgcgcagagccccattcattgccttgctgctaagtggcgccgcgtagtgccagtaggctccaagtcttcagggtctgtcccatcgggcaggaagccgtcatggcaaccctggaaaagctgatgaaggctttcgagtcgctcaagtcgtttcagcagcaacagcagcagcagccaccgccgcaggcgccgccgccaccgccgccgccgcctccgcctcaaccccctcagccgccgcctcaggggcagccgccgccgccaccaccgccgctgccaggtccggcagaggaaccgctgcaccgaccaaagaaggaactctcagccaccaagaaagaccgtgtgaatcattgtctaacaatatgtgaaaacattgtggcacagtctctcagaaattctccagaatttcagaaactcttgggcatcgctatggaactgtttctgctgtgcagtgacgatgcggagtcagatgtcagaatggtggctgatgagtgcctcaacaaagtcatcaaagctttgatggattctaatcttccaaggctacagttagaactctataaggaaattaaaaagaatggtgctcctcgaagtttgcgtgctgccctgtggaggtttgctgagctggctcacctggttcgacctcagaagtgcaggccttacctggtgaatcttcttccatgcctgacccgaacaagcaaaagaccggaggaatcagttcaggagaccttggctgcagctgttcctaaaattatggcttcttttggcaatttcgcaaatgacaatgaaattaaggttctgttgaaagctttcatagcaaatctgaagtcaagctctcccaccgtgcggcggacagcagccggctcagccgtgagcatctgccaacattctaggaggacacagtacttctacaactggctccttaatgtcctcctaggtctgctggttcccatggaagaagagcactccactctcctgatcctcggtgtgttgctcacattgaggtgtctagtgcccttgctccagcagcaggtcaaggacacaagtctaaaaggcagctttggggtgacacggaaagaaatggaagtctctccttctacagagcagcttgtccaggtttatgaactgactttgcatcatactcagcaccaagaccacaatgtggtgacaggggcactggagctcctgcagcagctcttccgtacccctccacctgaactcctgcaagcactgaccacaccaggagggcttgggcagctcactctggttcaagaagaggcccggggccgaggccgcagcgggagcatcgtggagcttttagctggagggggttcctcgtgcagccctgtcctctcaagaaagcagaaaggcaaagtgctcttaggagaggaagaagccttggaagatgactcggagtccaggtcagatgtcagcagctcagcctttgcagcctctgtgaagagtgagattggtggagagctcgctgcttcttcaggtgtttccactcctggttctgttggtcacgacatcatcactgagcagcctagatcccagcacacacttcaagcagactctgtggatttgtccggctgtgacctgaccagtgctgctactgatggggatgaggaggacatcttgagccacagctccagccagttcagtgctgtcccatccgaccctgccatggacctgaatgatgggacccaggcctcctcacccatcagtgacagttctcagaccaccactgaaggacctgattcagctgtgactccttcggacagttctgaaattgtgttagatggtgccgatagccagtatttaggcatgcagataggacagccacaggaggacgatgaggagggagctgcaggtgttctttctggtgaagtctcagatgttttcagaaactcttctctggcccttcaacaggcacacttgttggaaagaatgggccatagcaggcagccttccgacagcagtatagataagtatgtaacaagagatgaggttgctgaagccagtgatccagaaagcaagccttgccgaatcaaaggtgacataggacagcctaatgatgatgattctgctcctctggtacattgtgtccgtcttttatctgcttcctttttgttaactggtgaaaagaaagcactggttccagacagagacgtgagagtcagtgtgaaggccctggccctcagctgcattggtgcggctgtggcccttcatccagagtcgttcttcagcagactgtacaaagtacctcttaataccacggaaagtactgaggaacagtatgtttctgacatcttgaactacatcgatcatggagacccacaggtccgaggagctactgccattctctgtgggacccttgtctactccatcctcagtaggtcccgtctccgtgttggtgactggctgggcaacatcagaaccctgacaggaaatacattttctctggtggactgcattcctttactgcagaaaacgttgaaggatgaatcttctgttacttgcaagttggcttgtacagctgtgaggcactgtgtcctgagtctttgcagcagcagctacagtgacttgggattacaactgcttattgatatgctgcctctgaagaacagctcctactggctggtgaggaccgaactgctggacactctggcagagattgacttcaggctcgtgagttttttggaggcaaaagcagaaagtttacaccgaggggctcatcattatacagggtttctaaaactacaagaacgagtactcaataatgtggtcatttatttgcttggagatgaagaccccagggttcgacatgttgctgcaacatcattaacaaggcttgtcccaaagctgttttacaagtgtgaccaaggacaagctgatccagttgtggctgtagcgagggatcagagcagtgtctacctgaagctcctcatgcatgagacccagccaccatcacacttttctgtcagcaccatcaccagaatctatagaggctatagcttactgccaagtataacagatgtcaccatggaaaacaatctctcaagagttgttgccgcagtttctcatgaactcattacgtcaacaacacgggcactcacatttggatgctgtgaagccttgtgtcttctctcagcagcctttccagtttgcacttggagtttaggatggcactgtggagtgcccccactgagtgcctctgatgagtccaggaagagctgcactgttgggatggcctccatgattctcaccttgctttcatcagcttggttcccactggatctctcagcccatcaggatgccttgattttggctggaaacttgctagcagcgagtgcccccaagtctctgagaagttcatggacctctgaagaagaagccaactcagcagccaccagacaggaggaaatctggcctgctctgggggatcggactctagtgcccttggtggagcagcttttctcccacctgctgaaggtgatcaatatctgtgctcatgtcttggacgatgtgactcctggaccagcaatcaaggcagccttgccttctctaacaaaccccccttctctaagtcctattcgacggaaagggaaggagaaagaacctggagaacaagcttctactccaatgagtcccaagaaagttggtgaggccagtgcagcctctcgacaatcagacacctcaggacctgtcacagcaagtaaatcatcctcactggggagtttctaccatctcccctcctacctcaaactgcatgatgtcctgaaagccactcacgccaactataaggtcaccttagatcttcagaacagcactgaaaagtttggggggttcctgcgctctgccttggacgtcctttctcagattctagagctggcgacactgcaggacattggaaagtgtgttgaagaggtccttggatacctgaaatcctgctttagtcgagaaccaatgatggcaactgtctgtgtgcagcagctattgaagactctctttgggacaaacttagcctcacagtttgatggcttatcttccaaccccagcaagtctcagtgccgagctcagcgccttggctcttcaagtgtgaggcccggcttatatcactactgcttcatggcaccatacacgcacttcacacaggccttggctgacgcaagcctgaggaacatggtgcaggcggagcaggagcgtgatgcctcggggtggtttgatgtactccagaaagtgtctgcccaattgaagacgaacctaacaagcgtcacaaagaaccgtgcagataagaatgctattcataatcacattaggttatttgagcctcttgttataaaagcattgaagcagtacaccacgacaacatctgtacaattgcagaagcaggttttggatttgctggcacagctggttcagctacgggtcaattactgtctactggattcagaccaggtgttcatcgggtttgtgctgaagcagtttgagtacattgaagtgggccagttcagggaatcagaggcaattattccaaatatatttttcttcctggtattactgtcttatgagcgctaccattcaaaacagatcattggaattcctaaaatcatccagctgtgtgatggcatcatggccagtggaaggaaggccgttacacatgctatacctgctctgcagcccattgtccatgacctctttgtgttacgaggaacaaataaagctgatgcagggaaagagcttgagacacagaaggaggtggtggtctccatgctgttacgactcatccagtaccatcaggtgctggagatgttcatccttgtcctgcagcagtgccacaaggagaatgaggacaagtggaaacggctctctcggcaggtcgcagacatcatcctgcccatgttggccaagcagcagatgcatattgactctcatgaagcccttggagtgttaaataccttgtttgagattttggctccttcctccctacgtcctgtggacatgcttttgcggagtatgttcatcactccaagcacaatggcatctgtaagcactgtgcagctgtggatatctggaatcctcgccattctgagggttctcatttcccagtcaaccgaggacattgttctttgtcgtattcaggagctctccttctctccacacttgctctcctgtccagtgattaacaggttaaggggtggaggcggtaatgtaacactaggagaatgcagcgaagggaaacaaaagagtttgccagaagatacattctcaaggtttcttttacagctggttggtattcttctagaagacatcgttacaaaacagctcaaagtggacatgagtgaacagcagcatacgttctactgccaagagctaggcacactgctcatgtgtctgatccacatattcaaatctggaatgttccggagaatcacagcagctgccactagactcttcaccagtgatggctgtgaaggcagcttctatactctagagagcctgaatgcacgggtccgatccatggtgcccacgcacccagccctggtactgctctggtgtcagatcctacttctcatcaaccacactgaccaccggtggtgggcagaggtgcagcagacacccaagagacacagtctgtcctgcacgaagtcacttaacccccagaagtctggcgaagaggaggattctggctcggcagctcagctgggaatgtgcaatagagaaatagtgcgaagaggggcccttattctcttctgtgattatgtctgtcagaatctccatgactcagaacacttaacatggctcattgtgaatcacattcaagatctgatcagcttgtctcatgagcctccagtacaagactttattagtgccattcatcgtaattctgcagctagtggtctttttatccaggcaattcagtctcgctgtgaaaatctttcaacgccaaccactctgaagaaaacacttcagtgcttggaaggcatccatctcagccagtctggtgctgtgctcacactatatgtggacaggctcctgggcacccccttccgtgcgctggctcgcatggtcgacaccctggcctgtcgccgggtagaaatgcttttggctgcaaatttacagagcagcatggcccagttgccagaggaggaactaaacagaatccaagaacacctccagaacagtgggcttgcacaaagacaccaaaggctctattcactgctggacagattccgactctctactgtgcaggactcacttagccccttgcccccagtcacttcccacccactggatggggatgggcacacatctctggaaacagtgagtccagacaaagactggtacctccagcttgtcagatcccagtgttggaccagatcagattctgcactgctggaaggtgcagagctggtcaaccgtatccctgctgaagatatgaatgacttcatgatgagctcggagttcaacctaagccttttggctccctgtttaagccttggcatgagcgagattgctaatggccaaaagagtcccctctttgaagcagcccgtggggtgattctgaaccgggtgaccagtgttgttcagcagcttcctgctgtccatcaagtcttccagcccttcctgcctatagagcccacggcctactggaacaagttgaatgatctgcttggtgataccacatcataccagtctctgaccatacttgcccgtgccctggcacagtacctggtggtgctctccaaagtgcctgctcatttgcaccttcctcctgagaaggagggggacacggtgaagtttgtggtaatgacagttgaggccctgtcatggcatttgatccatgagcagatcccactgagtctggacctccaagccgggctagactgctgctgcctggcactacaggtgcctggcctctggggggtgctgtcctccccagagtacgtgactcatgcctgctccctcatccattgtgtgcgattcatcctggaagccattgcagtacaacctggagaccagcttctcggtcctgaaagcaggtcacatactccaagagctgtcagaaaggaggaagtagactcagatatacaaaacctcagtcatgtcacttcggcctgcgagatggtggcagacatggtggaatccctgcagtcagtgctggccttgggccacaagaggaacagcaccctgccttcatttctcacagctgtgctgaagaacattgttatcagtctggcccgactccccctagttaacagctatactcgtgtgcctcctctggtatggaaactcgggtggtcacccaagcctggaggggattttggcacagtgtttcctgagatccctgtagagttcctccaggagaaggagatcctcaaggagttcatctaccgcatcaacaccctagggtggaccaatcgtacccagttcgaagaaacttgggccaccctccttggtgtcctggtgactcagcccctggtgatggaacaggaagagagcccaccagaggaagacacagaaagaacccagatccatgtcctggctgtgcaggccatcacctctctagtgctcagtgcaatgaccgtgcctgtggctggcaatccagctgtaagctgcttggagcaacagccccggaacaagccactgaaggctctcgataccagatttggaagaaagctgagcatgatcagagggattgtagaacaagaaatccaagagatggtttcccagagagagaatactgccactcaccattctcaccaggcgtgggatcctgtcccttctctgttaccagctactacaggtgctcttatcagccatgacaagctgctgctgcagatcaacccagagcgggagccaggcaacatgagctacaagctgggccaggtgtccatacactccgtgtggctgggaaataacatcacacccctgagagaggaggaatgggatgaggaagaagaggaagaaagtgatgtccctgcaccaacgtcaccacctgtgtctccagtcaattccagaaaacaccgtgccggggttgatattcactcctgttcgcagtttctgcttgaattgtacagccgatggatcctgccatccagtgcagccagaaggacccccgtcatcctgatcagtgaagtggttcgatctcttcttgtagtgtcagacttattcaccgaacgtacccagtttgaaatgatgtatctgacgctgacagaactacggagagtgcacccttcagaagatgagatcctcattcagtacctggtgcctgccacctgtaaggcagctgctgtccttggaatggacaaaactgtggcagagccagtcagccgcctactggagagcacactgaggagcagccacctgcccagccagatcggagccctgcacggcatcctctatgtgttggagtgtgacctcttggatgacactgcaaagcagctcattccagttgttagtgactatctgctgtccaacctcaaaggaatagcccactgcgtgaacattcacagccagcagcatgtgctggtaatgtgtgccactgctttctacctgatggaaaactaccctctggatgtgggaccagaattttcagcatctgtgatacagatgtgtggagtaatgctgtctggaagtgaggagtccaccccctccatcatttaccactgtgccctccggggtctggagcggctcctgctgtctgagcagctatctcggctagacacagagtccttggtcaagctaagtgtggacagagtgaatgtacaaagcccacacagggccatggcagccctaggcctgatgctcacctgcatgtacacaggaaaggaaaaagccagtccaggcagagcttctgaccccagccctgctacacctgacagcgagtctgtgattgtagctatggagcgagtgtctgttctctttgataggatccgcaagggatttccctgtgaagccagggttgtggcaaggatcctgcctcagttcctagatgacttctttccacctcaagatgtcatgaacaaagtcattggagagttcctgtccaatcagcagccatacccacagttcatggccactgtagtttacaaggtttttcagactctgcacagtgctgggcagtcatccatggtccgggactgggtcatgctgtccctgtccaacttcacacaaagaactccagttgccatggccatgtggagcctctcctgcttccttgttagcgcatctaccagcccatgggtttctgcgatccttccacatgtcatcagcaggatgggcaaactggaacaggtggatgtgaaccttttctgcctggttgccacagacttctacagacaccagatagaggaggaattcgaccgcagggctttccagtctgtgtttgaggtggtggctgcaccaggaagtccataccacaggctgcttgcttgtttgcaaaatgttcacaaggtcaccacctgctgagtagtgcctgtgggacaaaaggctgaaagaaggcagctgctggggcctgagcctccaggagcctgctccaagcttctgctggggctgccttggccgtgcaggcttccacttgtgtcaagtggacagccaggcaatggcaggagtgctttgcaatgagggctatgcagggaacatgcactatgttggggttgagcctgagtcctgggtcctggcctcgctgcagctggtgacagtgctaggttgaccaggtgtttgtctttttcctagtgttcccctggccatagtcgccaggttgcagctgccctggtatgtggatcagaagtcctagctcttgccagatggttctgagcccgcctgctccactgggctggagagctccctcccacatttacccagtaggcatacctgccacaccagtgtctggacacaaaatgaatggtgtgtggggctgggaactggggctgccaggtgtccagcaccattttcctttctgtgttttcttctcaggagttaaaatttaattatatcagtaaagagattaattttaatgtaacttttcctatgcccgtgtaaagtgtgtgacttggcaaggcctgtgctgcatgtgacaaagtttatggaagtggaggggccttctggccgccactccctctcctgtagctactcagtctagtcgggcaggtccctcctgtagccctcccaacaccctgtggcacttgcacttcatacagctcccttttcttatgcattccattaagccagcacagagagaggtgttggtattgactgcctgtgtgagaatcctgcctgtggcctaactgaggaactgaaaaactgacttccactgttagagttataagaggcttgccctgtggcagctgccctcctctccccttcccaggcatgactgtcaagctatctcctccctggtgttgatgcactctcctagtctctcagcctgggtagaaacagcatctgctggacccaaagtggctatcccaataacctcatccctggttgtggctgacctgcactgtagcctgcccacacaccagctgaccattgtggatgctgtctgtccctttgtatcttctgcatggttgggacctgagaagtgctgacctgattaccccaaaggtgtctctgagctatggtttgttggtttgtctcagtttctcatagtcaagggaaagcttggtgtcctagcaacagttaagaatggacccagagcctcttttgccccttcccatcttgccttctgtcagcccagtagagtacagacctatgcctgtcagagcccagggaggactcagctgacaagatgaggcaccaaagggaaggttcaaaatcaggtcagcctctggcctcagacagcttcccatgctggtcagagccacctcttcccaaagcccaagcccagagtaaccaggtcatgttaatgaaaatgagctaccttcatttcctggcttggtttgggaactctgtttgctgtttgactatatgaccaagcagattttctgctgttccgctaagtcatatctgtatttctcagctgtagagtaggggagtggaatagtttggagatgtttctaggctacacaggaggaaagagcttgcagcctgtgattaactaactgtgcttcagtccatggattgctttcttgagacccttgaatttccctctatctttccatcatgacaagtagccttgctgctgggatgcaaggttccctaccaaacacaggttgtggggagcctcacacttggcctgactctcctcctatctgccctggcaaaaaccaccccaaggcgtggtaacaggaacagtggacatggattaggtctttcaagaggacgttaagggaagctactgaattttaatgaaagaaattcaccaatgcccctttgctgatttagggcttcttcttgtcaccctcaatttcccgcctagaagtgctcggggaccatgtgaaagttcttacagtgctgctgccacactctgaggttggtccaaccgctctgagatgagcatggtgcaggcctgattactcctcatggtagatgttcataaggaaactcaatataaaatctagagccattcaccaggggattatatcagtgagctcaacctcaagtttagttggcctcttgtttagtgtgatcagaaacaattcttagtatggggcaaggacagcctctgccacaaagttgttgtctgctcatgggtgccacaacctagagatgcacctgggtacaggcaggtatgtatttgtgtacacacataaacacacacacaatcctcaaagacatatgcaaggcctctaaaaatgcctgcctgttttttctgaaagcagacttttcttgcaactgccacatacagtcagctttgtgagtctagcatctgagaatgggactcaatttttaaaagtccatagctcattaaagtctcactggagacattgccccacctgtctaactgcaggagggactaaaactttttatcaaattcctcaaaaatctaaagatttccaagctttatttaaaaacaaaagttattttgactatgaggttttaggggtaggaggtgggatgttgtttctgtttccatggtggtactgtcaggaaagattttaataaaaccagggtagaacttttggcaatgcacttcagcatgtttcttctccaaaatgtgcctccctccctcccactgatggcccccttgacatgtaggtgacttagccactgccaagtgccctttatggttctctcattttgtctgcacatgtacccttcaggagggaagaactggagtggaaccacctcctgccctgtagaatgcagtgccagggaagggaccaatcctaacaggtgccttccctggcaggaagtaccttcccgtgagtgagtgaagcagctctgcttccggctcatgggacaggttttatacagcaatagcttgtctcacagccacgtcacaaggagtcttgcctcccattgtggggctgcagaattggtctccttgccacctgtgagcatccttccccacacagtctccttccctccctccttccctccctccctccctccctccctccgtccctccctccctccctcagcattgagcactaggatcatggctgctaccaggacaggcatgaagctgtcctccagggattggtatgtgggagtcgaagacactgagctgctgatgctgggtgtgggctcaggatatcatggttgggaaaagaattgttcctcagtgggtctggagcctccaggaaagaagaaccaatgctgagcagtgtgacaactaaagatgatatcaaggttcagggccaccctccatgtgtgcttgtcacactctagagccatcgaaggaactgctcccctcaagtgtctctggaaacaccctctgccgcaagctgggtgtaagataataggtggcagagacctatctgcagagatttggctgcattctagggggctcctgtccaagccttgctgctgtatgccatgggcttcactgggaactaggagggctgtgatgggtgtgccccggagcccagcctagacctggctgtccatttccaaaaggaaggactgacatgaaatgtatatttaaaatttttaaattgcagatattgtacagttgaattaaagaagcgattaaaccacctgttgttgctgttaaaaaaaaaaaaaaaaaa

SEQ ID NO: 3 - DNA, 13189 bp, Rattus norvegicus
gcactcgccgcgagggttgccgggacgggcccaagatggctgggagctttggttccgcttcggtctacctcgtagagccccattcattaccttgctgctaagtggcgctgcgtagtgcgaataggctccaagccttcagggtctgtcctgtcgggcaggaggccgtcatggcaaccctggaaaaactgatgaaggctttcgagtcgctcaagtcgttccagcagcaacagcagcagcagcagccgccgccgcaggcgccgccaccaccgccgccgccgccgcctcaaccccctcagccgccgcctcaggggcagccgccgccaccaccgccgctgccaggtccggccgaggagccgctgcaccgaccaaagaaggaactctcagccaccaagaaggaccgtgtgaatcactgtctaacaatatgtgaaaacattgtggcacagtctctcagaaattctccagaatttcagaaactcttgggcattgctatggaactgtttctgctgtgcagcgacgatgcggagtcagacgtcagaatggtggctgatgagtgcctcaacaaagtcatcaaagctttgatggactctaatcttccaaggctacagttagaactctataaggaaattaaaaagaatggtgctcctcgaagtttgcgtgcagctctgtggaggtttgctgagctggctcacctggttcgacctcagaagtgcaggccttatctggtgaatcttcttccatgtttgacccgaacaagcaaacgaccggaggagtcagttcaggagactttggctgcagctgttcctaaaattatggcctcttttggcaatttcgcgaatgacaatgaaattaaggttctattgaaagctttcatagcaaatctgaagtcaagctctcccactgtgcggcggacagcagctgggtcagcagtgagtatctgccagcactctaggaggacacagtacttctacaactggctcctgaatgtgctcctaggtttgctggttcccatggaggaagaccaccccactctcctgatccttggtgtgttgctcacactgaggtgtctagtgcccttgctccagcagcaggtcaaggacacaagtctaaagggcagctttggggtaacacggaaagaaatggaagtctctccttctgcagagcagcttgtccaggtttatgaactgactttgcatcacacacagcaccaagaccataatgtggtgacaggggcattggagctcctgcagcagctcttccgtacccctccacctgagctgctgcaagcactgaccacaccaggagggctcgggcagctcactctggttcgagaggaagccgggggccgaggccgcagcgggagtatcgtggagcttttagctggagggggttcctcatgcagccctgttctctcaagaaagcaaaaaggcaaagtgctcttaggagaggaagaagccttggaggatgactcggagtccaggtcagatgtcagcagctcagcctttgcagcctctgtgaagagtgagattggtggagagctcgctgcttcttcttcgggtgtctccactcccggttctgtaggtcacgacatcatcactgagcagcctcgatcccagcacacacttcaagcagactctgtggatttgtcaggctgtgacttgaccagtgctgctactgatggagatgaggaagacatcttgagccacagctccagccagttcagtgctgttccatccgaccctgccatggacctgaatgatgggacccaggcctcctcacccatcagtgacagttctcagaccaccactgaaggacctgattcagctgtgactccttctgacagttctgaaattgtcttagatggtgctgacagccagtatttaggcgtgcagataggacagccacaggaggaagacgaggaggaagctgcaggtgttctttctggtgaagtctcagacgttttcagaaactcttctctggcccttcagcaggcacacttgttggaaagaatgggtcatagccggcagccttctgacagcagtgttgataagtttgtttcaaaagatgaggttgctgaagctggggacccagaaagcaagccttgccgaatcaaaggtgacataggacagcctaatgatgatgattctgctcctctggtacattgtgtccgtcttttatccgcttcctttttgttaactggcgaaaagaaagcactggttccagacagagatgtgagagtcagtgtgaaggccctggccctcagctgtattggtgcagctgtggcccttcatccagagtcgttcttcagcaaactctacaaagtacctctcagtaccatggaaagtactgaggaacagtatgtctctgacatcctgaactacatcgatcatggagaccctcaggtgcgaggagctactgccattctctgtgggacccttgtctactccatcctcagcaggtcccgtctccgtgttggtgactggctgggcaccatcagggccctgacaggaaatacattttctctggtggactgcattcctttactgcagaaaactttgaaggatgaatcttctgttacttgcaagttggcttgtacagctgtgaggcactgtgtcctgagtctttgcagcagcagctacagtgacttgggattacaactgcttattgacatgctgcctctgaagaacagctcctactggctggtgaggactgaactgctggaaactcttgcagagattgatttcaggctggtgagttttttggaggcaaaagcagaaagtttacaccgaggggctcatcattatacagggtttctaaaactacaagaacgagtactcaataatgtggtcatttatttgcttggagatgaagaccccagggttcgacatgttgctgcgacgacattgacaagacttgtcccaaagctgttttataagtgtgaccaaggacaggctgacccagtcgtggctgtagcaagagatcaaagtagtgtttacctgaagctcctcatgcatgagacccagccaccatcccacttctccgtcagcaccataaccagaatctatagaggctacagcttactaccaagtgtaacagatgtcaccatggaaaacaacctctcaagagtcgttgccgcagtttctcatgaactcattacgtcaactacacgggcactcacatttgggtgctgtgaagccttgtgtgttctttcagccgcctttccagtttgcacttggagtctaggatggcactgtggagtgcccccactgagtgcctctgatgagtccaggaagagctgcactgttgggatggcctccatgattctcaccttgctttcatcagcttggttcccactggatctctcagcccatcaggatgccttgattttggctggaaacttgctagcagcgagtgcccccaagtctctgagaagctcatgggcctcggaagaagaaggcagctcagcagccaccagacaggaggagatctggcctgccctgggggatcggactctggtgcccatggtggagcagcttttctcccacctgctgaaggtgatcaatatctgtgctcatgtcttggatgacgtgactcctggaccagcaatcaaggcagctttgccttctctcacaaaccccccttctctaagtcctattcgacggaaagggaaggagaaagagcccggagaacaaacatccactccgatgagtcccaagaaaggtggagaggccagtacagcctctcgacagtcagacacctcaggacctgtcacagcgagtaaatcatcttcacttgggagtttctaccatctcccttcctacctcagactgcatgatgtcctgaaagccactcacgccaactataaggtcaccttagatcttcagaacagcactgaaaagtttggggggttcctgcgctctgccttggacgtcctttctcagattctagagctggcgacactgcaggacattggaaagtgtgttgaagaggtccttggatacttgaaatcctgctttagtcgagaaccaatgatggcgactgtctgtgttcagcagctattgaagactctctttgggacaaacttagcctcacagtttgatggcttatcttccaaccccagcaagtctcagtgccgagcacagcgccttggctcttccagtgtgaggcccggcttatatcactactgcttcatggcaccatacacgcacttcacgcaggctttggctgatgccagcctgaggaacatggtacaggcggaccaggagcacgatgcctcagggtggtttgatgtactccagaaagtgtctgctcagttgaagacgaaccttacaagtgtcacaaagaaccgtgcagataagaacgctattcataaccacattaggttatttgagcctcttgttataaaagcattgaagcagtacaccacgacaacatcagtacaactgcagaagcaggttttggatttgctggcacagctggttcagctacgggtcaattactgtctactggattcagatcaggtgttcatcgggtttgtgctgaagcagtttgagtacattgaagtgggccagttcagggaatcagaggcaattattccaaatatatttttcttcctggtactattatcttatgagcgctaccattcaaaacagatcattggaattcctaaaatcatccagctgtgtgatggcatcatggccagtggaaggaaggctgtcacacatgctattcctgcgctgcagcccattgtccatgacctctttgtgttaagaggaacaaataaagctgatgcagggaaagagcttgaaacccagaaggaggtggtggtctcaatgctgttacgactcatccagtaccatcaggtgctagagatgttcatcctcgtcctgcagcagtgccacaaagagaatgaggacaagtggaaacggctctctcggcaggtcgcagacatcatcctgcccatgttagccaagcagcagatgcatattgactctcatgaagcccttggagtattaaataccttgtttgagattttggctccttcctccctacgtcctgtggacatgcttttgcggagtatgttcatcactccaagcacaatggcatctgtaagcactgtgcagctgtggatatctggaatcctagccattctgagggttctcatttcccagtcaaccgaagacattgttctttctcgtattcaggagctctccttctctccatatttaatttcctgtccagtaattaacaggttaagggatggagacagtaatccaacactaggagaacgcagtgaagggaaacaagtaaagaatttgccagaagatacattctcaaggtttctcttacagctggttggtattcttctggaagacattgttacaaaacagctcaaagtggacatgagtgaacagcagcatacattctattgccaagagctcggcacactgctcatgtgtctgatccacatattcaaatctggaatgttccggagaatcacagccgctgccactagactcttcaccagtgatggctgtgaaggcagcttctatactctagatagcctgaatgcacgggtgcgagccatggtgcccacacacccagctctggtactgctctggtgtcagatcctactgctcatcaaccacactgaccaccgatggtgggccgaggtgcagcagacgcccaagagacacagtctgtcctgcacgaagtcactaaacccccagatatctgctgaagaggattctggctcagcagctcagcttggaatgtgcaatagagaaatagtacgaagaggggcccttattctcttctgtgattatgtctgtcagaatctccatgactcagaacacttaacatggctcattgtgaatcacattcaagatctgatcagcttgtcccacgagcctccagttcaagactttattagtgccattcatcgtaattctgcagctagtggtctttttatccaggcaattcagtctcgctgtgaaaatctttcaactccaaccactctgaagaaaacacttcagtgcttggaaggcatccatctcagccagtctggtgctgtgctcacactgtatgtggacaggctactgggcacccctttccgtgcgctggctcgcatggtcgacaccctggcctgtcgccgagtagaaatgcttttggctgcaaatttacagagcagcatggcccagttgccagaggaggaactgaacagaatccaggaacacctccagaacactgggcttgcacaaagacaccaaaggctctattcactgctggacagattccgactctctactgtgcaggactcacttagccccttgcccccagtcacttcccaccctctggatggggatgggcacacatccctggaaacagtgaatccggacaaagactggtacctccagcttgtcagatcccagtgttggaccaggtcagattctgcactgctggaaggtgcagagctggtgaaccgtatccctgctgaagatatgagtgacttcatgatgagctcggagttcaacctaagccttttggctccctgcttaagccttggcatgagcgagattgctaatggccaaaagagtcccctttttgaagcggctcgtagggtgactctggaccgggtgaccaatgtggttcagcagctgcctgcagtccatcaagtcttccagcctttcctgcctacagaacccacagcctactggagcaagctgaatgatctctttggtgataccacatcataccagtctctgaccacacttgcccgtgccctggcacagtacctggtggtgctctccaaagtgcctgctcctttgcaccttcctcctgagaaggaggggcacacggtgaagtttgtggtaatgacacttgaggccctgtcatggcatttgatccatgagcagatcccactgagtctggacctccaagccggcctagactgctgctgcctggcactgcaggtgcctggcctctggggggtgctgtcctccccagagtacgtgactcatacttgctcccttatccactgtgtgcgattcatcctggaagccattgcagtacaacctggagaccaacttcttggtccggaaagcaggtcacatactccaagggctgtcagaaaggaggaagtagactcagatatacaaaacctcagtcacatcacttcggcctgcgagatggtggcagacatggtggaatccctgcagtcggtgctggccctgggccacaagaggaacagcaccctaccttcatttctcacagctgtgctgaagaacattgttgtcagtctggcccgcctccccctcgttaacagctatactcgtgtgcctcctctggtatggaaactcgggtggtcacccaagcctggaggggatttcggcacagtgtttcctgagatccctgtagagttcctccaggagaaggaggtcctcaaggagttcatctaccgcatcaacaccctagggtggaccagtcgtactcaattcgaagaaacttgggccaccctccttggtgtcctggtgactcagcccttggtgatggaacaggaagagagcccaccagaggaagacaccgaaaggacccagatccacgtcctggctgtacaggccatcacctctctagtgctcagcgcaatggctgtgcctgtggctggcaatccagctgtaagctgcttggagcaacagccccggaacaagccactgaaggctctcgataccagatttggaagaaagttgagcatgatcagagggattgtagaacaagaaatccaagagatggtttcccaaagagagaatactgccactcatcattctcaccaggcatgggatcctgtcccttctctgttaccagctactacaggtgctcttatcagccatgacaagctgctgctgcagatcaactcagagcgggagccaggcaacatgagctacaagctgggccaggtgtccatacactccgtgtggctggggaacaacatcacacccctgagagaggaggaatgggatgaggaggaggaggaagaagcggatgcccctgcgccaacatcaccacctgtgtctccagtcaattccagaaaacaccgtgctggggttgatattcactcctgttcgcagtttctgcttgaattatacagccgttggatcctgccatccagtgcagccagaaggacccctgtcatcctgatcagtgaagtggttcgatctcttcttgtggtgtcagacttattcactgaacgtacccagtttgaaatgatgtatctgacgctgacagaactacggagagtgcacccttcagaagatgagatcctcattcaatacctggtgcctgccacctgtaaggcagctgctgttcttggaatggacaaaactgtggcagagccggtcagccgcctactggagagcacactcaggagcacccacctgcccagccagatcggagccctgcatggcatcctctatgtgttggagtgtgacctcttggatgacactgtaaagcagctcattccagttgttagtgactatctgctgtccaacctcaaaggaatagcccactgcgtgaacattcacagccagcagcatgtgctggtgatgtgtgccactgcattctacctgatggaaaactaccctctggatgtggggccagaattctcagcatctgtgatacagatgtgtggagtaatgctgtctggaagtgaggagtccaccccctccatcatttaccactgtgccctccggggtctggaacggctcctgctgtctgagcagctctctcggctagacacggagtccttggtcaagctaagtgtggacagagtgaatgtacaaagcccacacagggccatggcagccctaggcctgatgcttacctgcatgtacacaggaaaggaaaaagccagtccaggcagagcttctgaccccagccctgctacccctgacagcgagtctgtgattgtagctatggagcgagtgtctgtgctctttgacaggatccgcaagggatttccctgtgaagccagggtcgtggcaaggatcctgcctcagtttctagatgacttctttccacctcaagatgtcatgaacaaagtcattggagagttcctgtccaaccagcagccatacccacagttcatggccactgtagtatacaaggtttttcagactctgcacagtgctgggcagtcatccatggtccgggactgggttatgctgtctctgtccaacttcacacaaagaactccagttgccatggccatgtggagcctctcctgcttccttgtcagtgcatctaccagcccatgggtttctgcaatccttccacacgtcatcagcaggatgggcaaactggagcaggtggatgtgaaccttttctgcctggttgccacagacttctacagacaccagatagaggaggaattcgaccgcagggctttccagtctgtgtttgaggtggtggcagcaccaggaagtccataccacaggctgcttgcttgtttgcaaaatgttcacaaggtcaccgcctgctgagtagtacctgtggaacaagaggctgagaggaggcaactgctgtggctacagcctccaggggcctgcaccaagcttctgctaaggctgccttggacgtgcaggcttccacttgtgtcaagtggacagccaggcaatggcaggagtgctttgcaatgagagctatgcagggaacatgcactatgttggggttgagcctgagtcctgggtcctggcatcactgcagctggtggcagtgctaggttgaccaggtgtttgtctttttcttagtgttgccctggccatagttgccaggttgcagctgccctggtatgtggaacagaatccgagctcttgtaagatggttctgagcccccctgtcccactgggctggagagctccctcccacatttacccagcaggtgtacctgccacaccagtgtctggacacaaagtgaatggtgtgggggctgggaactgggactgccaggtgtccagcatcattttccctttctctgttttcttctcaggagttaaaatttaattatatcagtaaagagattaattttaatgtaactcttcctatgcccgtgtaaagtgtgtgacttggcaaggcctgtgctgcatgtgacaaagtttatggaagtggatgcgccttctggccaccactctctctcctgtagctactcagtctagtcgggcaggtccctcatgtagccctcccaacaccctatggcacttgcacttcacacggctcctttttcttatgcattccatttgactagcacagagtggtgttggtgttaactgccctatgtgagaatcctgcttgtggcccagcttatgagactgacttccacttaggattaagagaggcttgccctgcggcagacccccacccctaccccaggcatgactatcaagctgtctactcactagtgttgatgcactctcctagtctctcagcctgggcagagacagcatctgctggacccaaagaggctatttcaataatctcatccctggtcgtggctgacctgggctgtagcctgcccagacaccggctgaccattgtggatgctctctgtccctttgtatcttctgcatggttgggacctgaggaatgctagcccgatcaccccaaaggtgtctctgagctatggcttgttggttgtctccgtttctcttggtcaagggaaagctcaatgtcctagcaacaattaagaatggaaccagagcctcttttgccccttcccatcttgccttctgtcagcccttacagtacagacctatgcctttcagagccaagggaggactcggcctgacaagatgaggcaccaaagggaaggttcaaaatcaggtcagcctatggcctcagacagcttcccgtgctgctggtcagagccgcctcttcccaaggcccaagcccagagtagccaggacatgttgatgagaatgagccctggacacaggctgccttcgtcccctggcttggtccaggagctctgctggctgtgtgactgagcgggctctctgctgcccactcagtcctgtctgtaccaatcgactgcagagtggggagaggagtaatttggagctgtttctaggctacacgggaggaaagagcttgcagcctatgactaattaactgtgcttcagtctgtggactgctttcttaagaatttccttctgttttcccatcatgatgattaaaaggctgccgggatgcaaggttccctaccaaacacaggtacacaggttgtggggagcctcacacttggcctgattctattcctatctgccctggcaaaggccactgcaagccagcccagcccatcctggtgtcatggtaacaggaacagtggacatggatcaggtctttcaagaggaccttaaaggaagctactgaattttaatgaaagaaagtcaccaatgcccctttgctgatttagggtttctacttgttaccctagatatccctcctagaagtgcttggagaccacatgaaagttctcacaatgctgctgccacactctaaagttggtccaacagctctgagatgagcatgttgcaggcctgattaccgattactcctcatggtagatgttcataagaaaacagaatataaaatctagagccattcacctggggtttatatcagtgacttccagtttagttggtctcttgttcagtgtggtcagaaataactcttagtatgggacaagaacagcctctgctacaaagctgttgtctgctcatgggtgctgcaacctagagatgcacctgggcacaggcacacacgcacacacgcacacacacacacacacacacacacacacacctcaaagacatatgcaagacctctaaaaatgcctgtccattcttcctgaaagcagacttttcttgtaactgccacatacagtcagctttgtgagtctagcatctgagaatgggactcaatttttaaaagtccatagtcattaaagtcccactgaagacattgccccacctgtctaactgtaggaagaactaaaactttttatcaaattcctcaaaaatctatggatttccaaactttatttaaaaaaaaaaaagtaattttgactgtgaggttttgggggtaggaggtgggatgttgtttctgttttcctgctggtattatcaggaaagattttagtaaaaccagggtagaactatttggcaatgcacttaagtatgtttcttctccaaaatgtgcctccctcccactgatggccccttgacattaggtgactttgccactgccaagtgccctttactattctctcattttgtctgcacatgtacccttcaggagggaaggactagagtggaaccacctcctgccctgtagactgcggtgccagggaaggcactgaccctaacgggtgccctccctggcaggaagtaccttcctgtgagtgaggcagctctgctttcagctcatgggacagggtttatacagcaatagcttggctcacagccacctggcaaggagtcctgcctcccattgtagggctgcagaattagtctcctcctgcctctcgtgagcatccttccccactgcctgcctgcctccctccctccctccctccctcaacggtgagcactaggatcatggctgctgccaggacaggcacgaagctgtcttccagggattggtatgtgggagtagaagaccctgagagctgctgaggctgggtgggggctcaggatatcacggtttggaagagaactgttcctcagtgggtctggagcctccaggaaagaagaaccaatgccgagcagtgtgacaactgaagatgacatgaaggttcagggccacctccatgtgtgcttgtcacactttagagccatcgaaggaactgctcccctcaagtgtccggaaacaccctctgccacaagctgggtgtaaggtgacagacacctatctgcagagatttgcctgcattctagggggctcctgtccaggccttgctgctgtatgccatgggcttcactgggaactaggagggctgtgatgggtatgccccggagcccagcctagacctggccgtccatttccaagaggaaggactgacatgaaatgtatatttaaaatttttaaattgcagatattgtacatttgaattaaagaagcaattaaactacccgttgttgctgtt

SEQ ID NO: 4 - DNA, 13328 bp, Macaca fascicularis
aggcgccgcgggggctgccgggacgggtccaagatggacggccgcttcggttccgcttttacccgcggcccagagccccattcattgccccggtgctgagcggcgctgcgagtcggcccgaggcctccggggactgcccagccgggcgggagaccgccatggcgaccctggaaaagctgatgaaggccttcgagtctctcaagtccttccagcagcagcagcagcagcagccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcggatgtcagaatggtggctgatgaatgcctcaacaaagttatcaaagctttgatggattctaatcttccaaggttacagctcgagctctataaagaaattaaaaagaatggtgcccctcggagtttgcgtgctgccctgtggaggtttgccgagctggctcacctggttcggcctcagaaatgcaggccttacctggtgaaccttctgccgtgcctaagtcgaacaagcaagagacccgaggaatcagtccaggagaccttggctgcagctgttcccaaaattatggcttctttcggcaattttgcaaatgacaatgaaattaaggttttgttaaaggccttcatagcgaacctgaagtcaagctcccccaccattcggcggacagctgctggatcagcagtgagcatctgccagcactcaagaaggacacagtatttctatagctggctactaaatgtgctcttaggcttactggttcctgtcgaggaggagcactccaccctgctgattcttggcgtgctgctcaccctgaggtatttggtgcccttgctgcagcagcaggtcaaggatacaagcctgaaaggcagcttcggagtgacacggaaagaaatggaggtctgtccttctgcggagcagcttgtccaggtttatgaactgacgttacatcatacacagcaccaagaccacaatgttgtgaccggagccctggagctgttgcagcagctcttcagaacgcctccccccgagcttctgcaagccctgaccacagtggggggcattgggcagctcaccgccgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgcctttgcagcctcagtgaaggatgatatcagtggagagctggctacttcttcaggggtttccactccagggtcagcaggtcacgacatcatcacggagcagccacggtcacagcacacgctgcaggcggactcagtggatctggccagctgtgacttgacaagctctgccacggatggggatgaggaggatatcttgagccacagctccagccaggtcagcgccgtcccatctgaccctgccatggacctgaatgatgggacccaggcctcctcgcccatcagcgacagctcccagaccaccaccgaagggcctgattcagctgtcaccccttcagacagttctgaaattgtgttagacggtaccgacaaccagtatttgggcctgcagattggacagccccaggatgaagatgaggaagccacaggtgttcttcctgacgaagcctcggaggccttcaggaactcttccatggcccttcaacaagcacatttattgaaaaacatgagtcacagcaggcagccttctgacagcagtgttgataaatttgtgttgagagatgaagctactgaaccgggtgatcaagaaaacaagccttgccgcatcaaaggtgacatcggacagtccactgatgatgattctgcacctcttgtccattgtgtccgccttttatctgcttcgtttttgctaacagggggaaaaaatgtgctggttccggaccgggatgtgagggtcagcgtgaaggccctggccctcagctgtgtgggagcagctgtggctctccacccagaatctttcttcagcaaactctataaagttcctcttgacaccacagaataccctgaggaacaatatgtctcagatatcttgaactacatcgatcatggagacccacaggttcgaggagccactgccattctctgtgggaccctcatctgctccatcctcagcaggtcccgcttccacgtgggagattggatgggcgccattagaaccctgacaggaaacacattttctttggcggattgcattcctttgctgcggaaaacactgaaggacgagtcttctgtcacttgcaagctggcttgtacagctgtgaggcattgtgtcatgagtctctgcagcagcagctacagtgagttaggactgcagctgatcatcgacgtgctgactctgaggaacagttcctattggctggtgaggacagagcttctggaaacccttgcggagattgacttcaggctggtgagctttttggaggcaaaagcagaaaacttacacagaggggctcatcattatacagggcttttaaagctgcaagaacgagtgctcaataatgttgtcatccatttgcttggggatgaagaccccagggtgcgacatgttgctgcagcatcattaattaggcttgtcccaaagctgttttataaatgtgaccaaggacaagctgacccagtagtggccgtggcaagagatcaaagcagtgtttacctgaaacttctcatgcatgagacgcagcctccatctcatttctccgtcagcacaataaccagaatatacagaggctataacctactaccaagcataacagatgtcactatggaaaataacctttcaagagttattgcagcagtttctcatgaactgatcacatcaaccacgagagcactcacttttggatgctgtgaagctttgtgtcttctttccactgccttcccagtttgcatttggagtttaggttggcactgtggagtgcctccactgagcgcctccgatgagtctaggaagagctgtaccgttgggatggccacgatgattctgaccctgctctcgtcagcttggttcccattggatctctcagcccatcaagatgctttgattttggccggaaacttgcttgcagccagtgctcctaaatctctgagaagttcatgggcctctgaagaagaagccaacccagcagccaccaagcaagaggaggtctggccagccctaggggaccgggccttggtgcccatggtggagcagctcttctcccacctgctgaaggtgatcaacatttgtgcacatgtcctggacgacgtggctcctggaccggcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacgcacgctaactacaaggtcaccttggatcttcagaacagcacggaaaaatttggagggtttcttcgctcagccttggacgttctctctcagattctagagctggccacactgcaggacattgggaagtgtgttgaggagatcctaggatacctgaaatcctgctttagtcgagaaccaatgatggcaactgtttgtgttcaacaattgttgaagactctctttgggacaaacttggcctcccagtttgacggcttatcatccaaccccagcaagtcacaaggccgagcacagcgccttggctcctccagtgtgaggccaggcttgtaccactactgcttcatggccccgtacacccacttcacccaggccctcgctgacgccagcttgaggaacatggtgcaggcggagcaggagcacgacacctcgggatggtttgatgtcctccagaaagtgtctacccagttgaagacgaacctcacaagtgtcacaaagaaccgtgcagataagaatgctattcataatcacattcgtttgtttgaacctcttgttataaaagctttaaaacagtacacgacaacaacatctgtgcagttacagaagcaggttttagatttgctggcgcagctggttcagttacgggttaattactgtcttctggattcagatcaggtgtttattggctttgtattgaaacagttcgaatacattgaagtgggccagttcagggaatcagaggcaatcattccaaacatctttttcttcttggtattactgtcttatgaacgctatcattcaaaacagatcattggaattcctaaaatcattcagctctgtgatggcatcatggccagtggaaggaaggctgtgacacacgccataccggctctgcagcccatagtccatgacctttttgtattaagaggaacaaataaagctgatgcaggaaaagagcttgaaacccaaaaagaagtggtggtatcaatgttactgagactcatccagtaccatcaggtgttggagatgttcattctcgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtggacatgcttttacggagtatgttcgtcactccaaacacaatggcatctgtgagcactgttcaactgtggatatcaggaattctggccattttgagggttctgatttcccagtcaactgaagatattgttctttctcgtattcaggagctctctttctctccatatttaatctcctgtccagtaattaataggctaagagatggggacagtaattcagcactagaagaacacagtgaagggaaacaaataaagaatttgccggaagaaacattttcaaggtttctattacaactggtgggtattcttttagaagacattgttacaaaacagctgaaggtggaaatgagtgagcagcaacatactttctattgccaagaactaggcactctgctaatgtgtctgatccacatcttcaagtctggaatgttccggagaatcacagcagctgccactagactgttccgcagtgatggctgtggcggcagtttctacaccctggacagcttgaatttgcgggctcgttccatgatcaccacccacccggccctggtgctgctctggtgtcagatcctgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgctgttcatcggaactccgctgccagcggcctcttcatccaggcaattcagtctcgttgtgaaaacctttcaactccaaccactctgaagaaaactcttcagtgcttggaggggatccatctcagccagtcgggagctgtgctcacgttgtatgtggacaggctgctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccagaggctctattccctgctggacaggtttcgtctctccaccatgcaagactcacttagtccctctcccccagtctcttcccacccgctggacggggacgggcacgtgtcactggaaacagtgagtccggacaaagactggtacattcatcttgtcaaatcccagtgttggaccaggtcagattctgcgctgctggaaggtgcagagctggtgaatcggattcctgctgaagatatgagtgccttcatgatgaactcggagttcaacctaagcctgctagctccatgcttaagcctagggatgagtgaaatttctggtggccagaggagtccgctttttgaagcagcccgtgaggtgactctggcccgcgtgagcagcaccgtgcagcagctccctgctgtccaccacgtcttccagtccgacctgcctgcagagccggcggcctactggagcaagttgaatgatctatttggggatgctgcgctgtatcagtccctgaccactctggcccgggccctggcacagtacctggtggcggtctccaaactgcccagtcacttgcaccttcctcctgagaaagagaaggacaccatgaaattcgtggtggcaacccttgaggccctgtcctggcatttgatccatgagcagattccgctgagtctggatctccaggcagggctggactgctgctgcctggccctgcagctgcctggcctctggagcgtggtctcctccgcagagtttgtgacccacgcctgctccctcatccactgtgtgcacttcatcctggaggccgttgcagtgcagcctggagagcagcttcttagtccagaaagaaggacaaataccccaaaagccatcagagaggaggaggaggaaatagatcctaacacacagaatccgaagtatatcaccgcagcctgtgagatggtggcagaaatggtggagtctctgcagtcggtgttggctttgggtcataaaaggaatagtggcgtgccggcgtttctcacgtcagtgctcaggaacatcgtcgtcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacgctaggctggaccagtcgtactcagtttgaagaaacttgggccactctccttggtgtcctggtgacgcagcccctcgtgatggagcaggaggagagcccaccagaagaagacacagagaggacgcagatcaacgtcctggccgtgcaggccatcacctcactggtgctcagtgcaatgaccgtgcctgtggccggcaacccagctgtgagctgcttggagcagcagcctcggaacaagcctctgaaagctctggacaccaggtttgggaggaagctgagcattatcagagggattgtagagcaagagattcaagcaatggtttcaaagagagagaacatcgccacccatcatttataccaggcgtgggatcctgtcccttctctgtccccggctaccacaggtgccctcatcagccacgagaagctgctgctgcagatcaaccccgagcgggagctggggagcgtgagctacaaactcggccaggtgtccatacactctgtgtggctggggaacagcatcacacccctaagggaggaggaatgggacgaggaggaggaggaggaggccgacgcccctgcaccttcatcaccacccacgtctccagtcaactccaggaaacaccgggctggagttgacatccattcctgttcgcagtttttactcgagttgtacagccgctggatcctgccatccaactcagccaggaggaccccggccatcctgatcagtgaggtggttcgatcccttctggtggtctcagacttgttcactgagcgcaaccagtttgagctgatgtatgtgacgctgacagaactgcgaagggtgcatccttcagaagacgagatcctcgctcagtacctggtgcccgccacctgcaaggcagctgccgtccttgggatggacaaggtcgtggcggagcctgtcagccgcctgctggagagcacactcaggagcagccacctgcccagcagggtcggagccctgcacggcatcctctatgtgctggagtgcgacctgctggacgatactgccaagcagctcatcccagtcatcagtgactatctcctctccaacctgaaagggatcgcccactgcgtgaacattcacagccagcagcacgtactggtcatgtgtgccactgcgttttacctgattgagaactatcctctggacgtagggccagaattttcagcatcaataatacagatgtgtggggtgatgctgtccggaagtgaggagtccaccccctctatcatttaccactgtgccctcagaggcctggagcgcctcctgctctctgagcagctctcccgcctggatgcagaatccctggtcaagctgagtgtggacagagtgaacgtgcacagcccgcaccgggccatggcggctctgggcttgatgctcacctgcatgtacacaggaaaggagaaagtcagtccgggtagaacttcagaccctaatcctgcagccccagacagcgagtcggtgattgttgctatggagcgggtgtctgttctttttgataggatcaggaaaggctttccttgtgaagccagagtggtggcgaggatcctgccccagtttctagatgacttcttcccaccccaggacatcatgaacaaagtcatcggagagtttctgtccaaccagcagccatacccccagttcatggccacggtggtgtataaggtgtttcagactctgcacagcaccgggcagtcatccatggtccgggactgggtcatgctgtccctctccaacttcacgcagaggaccccagtcgccatggccacatggagcctctcctgcttcttcgtcagcgcgtccaccagcccatgggttgcggcgatcctcccacatgtcatcagcaggatgggaaagctggagcaggtggacgtcaaccttttctgcctggttgccacagacttttacagacaccagatagaggaggagctcgaccgcagggccttccagtctgtgtttgaggtggttgcagctccaggaagcccatatcaccggctgctgacttgtttacgaaatgtccacaaggtcaccacctgctgagcgccatggtgggagagactgtgaggcggcagctggggctggagcctccagaaatctgcgccctgtgccctgcctccaccgagccagcttggtccctgtgggcttccgcacatgccgcgggcggccaggcaacgtgcgtgtctctgccatatggcagaagtgctctttgtggtacagtggccaggcaaggagtatctgcagtcccggtggggctgagcctgaggccttccggagagcaggagcagctgtgctgcacgccatgtgggtgaccaggtcctttctcctgatgctcacctgttgggtgttgccaggctgcagctgctcttgcatctgggccggaagtcctccctcctgcaggctggctgtgggcccctctgctgtcctgcagtagaaggtgccgtgagcaggctttgggaacactggcctgtgtcttcctggtggggtgtgcatgccacgccctgtgtctgtatgcacagatgccatggcatgtgctgggccagtggctgggggtgctagacacccagcaccattctcccttctctcttttcttctcaggatttaaaatttaattatatcagtaaagagattaattttaacgtaactctttctatgcccgtgtaaagtatgtgaattgcaaggcctgtgctgcatgcgacagtgttcggggaggtgggcagggcccctggccacgctccctctcctgtagccactggcatagccttcctgagcacccgctgacatttccgttgtacatgttcctgtttatgcattcacaaggtgactgggatgtagagaggcgctagtgtgcaggtggccacagcaggactaaggacaggcccccactgtcctaggggcatgctcgcctgcagcccctccttcttgggcacagacaactgttgttctccacccacattagggacagcagcctccctatcagctgagaaggccagccctccctggctgtgagcagcctccgctgtgtccagagacatgggcctcccactcctgttccttgctagccctggggcggtgtctgcccaggagctggctggccggtgttgggatctgccgttccatggatgcatgccccaagggtgtcactgagctgtgttttgtctgagcctctcttggtcaacagcaaagcttggcgtcttggcactgttagtgacagagcctggcatcccttctgcccccgttccagctgacatcttgcacggggaccccttttagtcaggagagtgcagatctgtgctcattggagactgccccactgccctgtcagagccgccactcctatccccaggccaggtccctggaccagcctcttgtttgcaggcccagaggagccaagtcattaaaatggaagtggattctggatggccggctgctgctgacataggagctggatttgggagctctgagatggggcaggagctctgcttcctcagcccttgaggcgagccaggcgaggttggcgactgtcatgtggcttggtttgctcatgcctgttgatgttttgggtattgaatatggtaagtggaggaaatgcttttctggagtctgtgcaggtgctgccttgagaccctcaagcttccacctgtccctctcctatgtggcagctgaggagcagctgacatgtggacttgtgtgctgcccacatacatgagggggcgctgaaagggagcccctgctcaaagggagcccctcctctgagcagcctttgacaggcctgtatgaggcttttcccaccagctcccaacagaggcctcccccagccaggaccacctcgtcctcgtggcagggcagcaggagcggtagaaaggggtctgatgtttgaggaggcccttaagggaagctactgaattttaacaagaaaaccaccgttcttccgtattggttgggggctcctgtttctcatcctagcttcttcctggaaagcctgctagaagctttgggaatgaggggaaagttctcagaaccgttgctgctccccacccacctcccctgcagtaagttatgtcaacagctcggagacagaagtatcacaggccagatgttgttctgctagatgtttacatttgtaagaaataacactgtgaatgtaaaacggagccattccccttggaatgcatatcgctgggctcaacacagagtttgtcttccttttgtttacgacgtgatctaaaacagtccttagcaaggggctcagaacaccccgctctggcagtgggtgtcccccactcccaaaggcctgcctgtgtgctccagagatgaatatgagctcattagtaaaatgactttacccatgcgtaagtcaagtacacgtgcacgtgcatatggacacatctgtagttttatacacgcacatctcaagacagagatgcatggcctccaagagtgcccgtgtcggttcttcctggaagttgactttcctcagacctgccaggtaaagttagctgtgtgacgggcgtccaggcgcggggcttggtcagagcagggctcattcatggctcactaggatcccaccggagaaaacggtctccatatcaactctgccgaagggaggaagactttgtcgcgttcctaaaaaacctatggcaagcaccaatcatattatccaaattttgttgaaaatgtgattaatttggttgtcaagttttgggggtgagctgtggggagactgcttttgttttgctgctggtaatatcaggaaagactttaatgaaaccagggtagaattgtttggcaatgcactgaagcgcgtttctttcccaaaacgtgcctcccttccgctgcgggcccagctgagtctgtgtaggtgacgtttccggctgccaagcgctctttgttactgtccacccccatttctgccagcacacgtgtcctttcaggaggaaaatgtgaagctgaaacccctccagacacccagaatgtagcatctgagaaggccctgtgccctaaaggacacccccgcccccaccttcatggaggggtcattccagagccctcggagccgatgaacagctcgtcctcttggagctgagctgagccccccacggagctcgggacggatagtaaacagcaataactcggtctgtggctgcctggcaggtggaagttcctccccctgaggggcggagtgaggttagttctgtgtgtctgtggggtggagtcagcctgctcctgctacctgtgagcatcctgcccagcagacatcctcacccggctttgtccctccccacttcctccctctgcggggaggacccaggaccacagctgctggccagggtaggcttggagctgtgctccggaggggccacctgagggagcgagaagaaggaagatcttgagagctgccgaggcaccctggagagctcaggatggtccaggcgagaagaggacactcgctcgccaggcctgggcctcctgggaaggagggagccgctcagagcgccgcatgacaactgaaggcaacctggaaggttcagaggccactcttcccccgtgtgcctgtcacgctctggtgcagtccaaggaacgccttcccctcagttgtttccaaaagcagagtctcccgctgcaatctgggtggtgattgccagccttggaggattgtggccaacgtggacctgcctacggagggtgggctctgacccacgtggggcctccttgtccaggtctcattgctttgcgctgtggtcagagggactgtcagctgagcctgagctcccctggagccagcagggctgtgatgggtgagtcccggagccccacccagacctgactgcttctgagagcaaagggaaggactgacgagagatgtatatttaatttttttaactgctgcaaacattgtacatccaaattaaaggaaaaacattgaaaccatca

SEQ ID NO: 5 - DNA, 13447 bp, Macaca mulatta
gcaaggcgccgcgggggctgccgggacgggtccaagatggacggccgcttcggttccgcttttacccgcggcccagagccccattcattgccccggtgctgagcggcgctgcgagtcggcccgaggcctccggggactgcctagccgggcgggagaccgccatggcgaccctggaaaagctgatgaaggccttcgagtctctcaagtccttccagcagcagcagcagcagcagcagcagcaacagccgccgccgccgccgccgccgccgcctcctcctcctcagcttcctcagccgccgcaggcacagccgatgctgcctcagccgcagccgcccccgccgccgcccccgccaccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcggatgtcagaatggtggctgatgaatgcctcaacaaagttatcaaagctttgatggattctaatcttccaaggttacagctcgagctctataaagaaattaaaaagaatggtgcccctcggagtttgcgtgctgccctgtggaggtttgccgagctggctcacctggttcggcctcagaaatgcaggccttacctggtgaaccttctgccgtgcctaagtcgaacaagcaagagacccgaggaatcagtccaggagaccttggctgcagctgttcccaaaattatggcttctttcggcaattttgcaaatgacaatgaaattaaggttttgttaaaggccttcatagcgaacctgaagtcaagctcccccactattcggcggacagctgctggatcagcagtgagcatctgccagcactcaagaaggacacagtatttctatagctggctactaaatgtgctcttaggcttactggttcctgtcgaggaggagcactccaccctgctgattcttggcgtgctgctcaccctgaggtatttggtgcccttgctgcagcagcaggtcaaggatacaagcctgaaaggcagcttcggagtgacacggaaagaaatggaggtctctccttctgcagagcagcttgtccaggtttatgaactgacgttacatcatacacagcaccaagaccacaatgttgtgaccggagccctggagctgttgcagcagctcttcagaacgcctccccccgagcttctgcaagccctgaccacagtggggggcattgggcagcttaccgccgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgcctttgcagcctcagtgaaggatgatatcagtggagagctggctacttcttcaggggtttccactccagggtcagcaggtcacgacatcatcacggagcagccacggtcacagcacacgctgcaggcggactcagtggatctggccagctgtgacttgacaagctctgccacggatggggatgaggaggatatcttgagccacagctccagccaggtcagcgccgtcccatctgaccctgccatggacctgaatgatgggacccaggcctcctcgcccatcagcgacagctcccagaccaccaccgaagggcctgattcagctgtcaccccttcagacagttctgaaattgtgttagacggtaccgacaaccagtatttgggcctgcagattggacagccccaggatgaagatgaggaagccacaggtgttcttcctgacgaagcctcggaggccttcaggaactcttccatggcccttcaacaagcacatttattgaaaaacatgagtcacagcaggcagccttctgacagcagtgttgataaatttgtgttgagagatgaagctactgaaccgggtgatcaagaaaacaagccttgccgcatcaaaggtgacattggacagtccactgatgatgattctgcacctcttgtccattgtgtccgccttttatctgcttcatttttgctaacagggggaaaaaatgtgctggttccggaccgggatgtgagggtcagcgtgaaggccctggccctcagctgtgtgggagcagctgtggctctccacccagaatctttcttcagcaaactctataaagttcctcttgacaccacagaataccctgaggaacaatatgtctcagatatcttgaactacatcgatcatggagacccacaggttcgaggagccactgccattctctgtgggaccctcatctgctccatcctcagcaggtcccgcttccacgtgggagattggatgggcgccattagaaccctgacaggaaacacattttctttggcggattgcattcctttgctgcggaaaacactgaaggacgagtcttctgtcacttgcaagctggcctgtacagctgtgaggcattgtgtcatgagtctctgcagcagcagctacagtgagttaggactgcagctgatcatcgacgtgctgactctgaggaacagttcctattggctggtgaggacagagcttctggaaacccttgcggagattgacttcaggctggtgagctttttggaggcaaaagcagaaaacttacacagaggggctcatcattatacagggcttttaaagctgcaagaacgagtgctcaataatgttgtcatccatttgcttggggatgaagaccccagggtgcgacatgttgctgcagcatcattaattaggcttgtcccaaagctgttttataaatgtgaccaaggacaagctgacccagtagtggccgtggcaagagatcaaagcagtgtttacctgaaacttctcatgcatgagacgcagcctccatctcatttctccgtcagcacaataaccagaatatacagaggctataacctactgccaagcataacagatgtcactatggaaaataacctttcaagagttattgcagcagtttctcatgaactgatcacatcaaccacgagagcactcacttttggatgctgtgaagctttgtgtcttctttccactgccttcccagtttgcatttggagtttaggttggcactgtggagtgcctccactgagcgcctccgatgagtctaggaagagctgtaccgttgggatggccacgatgattctgaccctgctctcgtcagcttggttcccattggatctctcagcccatcaagatgctttgattttggccggaaacttgcttgcagccagtgctcctaaatctctgagaagttcatgggcctctgaagaagaagccaacccagcagccaccaagcaagaggaggtctggccagccctgggggaccgggccttggtgcccatggtggagcagctcttctcccacctgctgaaggtgatcaacatttgtgcacatgtcctggacgacgtggctcctggaccggcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacgcacgctaactacaaggtcaccttggatcttcagaacagcacggaaaaatttggagggtttcttcgctcagccttggacgttctctctcagattctagagctggccacactgcaggacattgggaagtgtgttgaggagatcctaggatacctgaaatcctgctttagtcgagaaccaatgatggcaactgtttgtgttcaacaattgttgaagactctctttgggacaaacttggcctcccagtttgacggcttatcatccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagcacgacacctcgggatggtttgatgtcctccagaaagtgtctacccagttgaagacgaacctcacaagtgtcacaaagaaccgtgcagataagaatgctattcataatcacattcgtttgtttgaacctcttgttataaaagctttaaaacagtacacgacaacaacatctgtgcagttacagaagcaggttttagatttgctggcgcagctggttcagttacgggttaattactgtcttctggattcagatcaggtgtttattggctttgtattgaaacagttcgaatacattgaagtgggccagttcagggaatcagaggcaatcattccaaacatctttttcttcttggtattactgtcttatgaacgctatcattcaaaacagatcattggaattcctaaaatcattcagctctgtgatggcatcatggccagtggaaggaaggctgtgacacacgccataccggctctgcagcccatagtccatgacctttttgtattaagaggaacaaataaagctgatgcaggaaaagagcttgaaacccaaaaagaagtggtggtatcaatgttactgagactcatccagtaccatcaggtgttggagatgttcattctcgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtggacatgcttttacggagtatgttcgtcactccaaacacaatggcatctgtgagcactgttcaactgtggatatcaggaattctggccattttgagggttctgatttcccagtcaactgaagatattgttctttctcgtattcaggagctctctttctctccatatttaatctcctgtccagtaattaataggctaagagatggggacagtaattcagcactagaagaacacagtgaagggaaacaaataaagaatttgccagaagaaacattttcaaggtttctattacaactggtgggtattcttttagaagacattgttacaaaacagctgaaggtggaaatgagtgagcagcaacatactttctattgccaagaactaggcactctgctaatgtgtctgatccacatcttcaagtctggaatgttccggagaatcacagcagctgccactagactgttccgcagtgatggctgtggcggcagtttctacaccctggacagcttgaatttgcgggctcgttccatgatcaccacccacccggccctggtgctgctctggtgtcagatcctgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggagtgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgctgttcatcggaactccgctgccagcggcctcttcatccaggcaattcagtctcgttgtgaaaacctttcaactccaaccactctgaagaaaactcttcagtgcttggaggggatccatctcagccagtcgggagctgtgctcacgttgtatgtggacaggctgctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccagaggctctattccctgctggacaggtttcgtctctccaccatgcaagactcacttagtccctctcccccagtctcttcccacccgctggacggggatgggcacgtgtcactggaaacagtgagtccggacaaagactggtacattcatcttgtcaaatcccagtgttggaccaggtcagattctgcactgctggaaggtgcagagctggtgaatcggattcctgctgaagatatgagtgccttcatgatgaactcggagttcaacctaagcctgctagctccatgcttaagcctagggatgagtgaaatttctggtggccagaagagtccgctttttgaagcagcctgtgaggtgactctggcccgcgtgagcagcaccgtgcagcagctccctgctgtccaccacgtcttccagtccgacctgcctgcagagccggcggcctactggagcaagttgaatgatctatttggggatgctgcgctgtatcagtccctgaccactctggcccgggccctggcacagtacctggtggcggtctccaaactgcccagtcacttgcaccttcctcctgagaaagagaaggacaccatgaaattcgtggtggcaacccttgaggccctgtcctggcatttgatccatgagcagattccgctgagtctggatctccaggcagggctggactgctgctgcctggccctgcagctgcctggcctctggagcgtggtctcctccgcagagtttgtgacccacgcctgctccctcatccactgtgtgcacttcatcctggaggccgttgcagtgcagcctggagagcagcttcttagtccagaaagaaggacaaataccccaaaagtcatcagagaggaggaggaggaaatagatcctaacacacagaatccgaagtatatcaccgcagcctgtgagatggtggcagaaatggtggagtctctgcagtcggtgttggctttgggtcataaaaggaatagtggcgtgccggcgtttctcacgtcagtgctcaggaacatcgtcgtcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacgctaggctggaccagtcgtactcagtttgaagaaacttgggccactctccttggtgtcctggtgacgcagcccctcgtgatggagcaggaggagagcccaccagaagaagacacagagaggacgcagatcaacgtcctggccgtgcaggccatcacctcactggtgctcagtgcaatgaccgtgcctgtggccggcaacccagctgtgagctgcttggagcagcagcctcggaacaagcctctgaaagctctggacaccaggtttgggaggaagctgagcattatcagagggattgtagagcaagagattcaagcaatggtttcaaagagagagaacatcgccacccatcatttataccaggcgtgggatcctgtcccttctctgtccccggctaccacaggtgccctcatcagccacgagaagctgctgctgcagatcaaccccgagcgggagctggggagcgtgagctacaaactcggccaggtgtccatacactctgtgtggctggggaacagcatcacacccctaagggaggaggaatgggacgaggaggaggaggaggaggccgacgcccctgcaccttcatcaccacccacgtctccagtcaactccaggaaacaccgggctggagttgacatccattcctgttcgcagtttttactcgagttgtacagccgctggatcctgccatccaactcagccaggaggaccccggccatcctgatcagtgaggtggttcgatcccttctggtggtctcagacttgttcactgagcgcaaccagtttgagctgatgtatgtgacgctgacagaactgcgaagggtgcatccttcagaagacgagatcctcgctcagtacctggtgcccgccacctgcaaggcagctgccgtccttgggatggacaaggtcgtggcggagcctgtcagccgcctgctggagagcacactcaggagcagccacctgcccagcagggtcggagccctgcacggcatcctctatgtgctggagtgcgacctgctggacgatactgccaagcagctcatcccagtcatcagtgactatctcctctccaacctgaaagggatcgcccactgcgtgaacattcacagccagcagcacgtactggtcatgtgtgccactgcgttttacctgattgagaactatcctctggacgtagggccagaattttcagcatcaataatacagatgtgtggggtgatgctgtccggaagtgaggagtccaccccctctatcatttaccactgtgccctcagaggcctggagcgcctcctgctctctgagcagctctcccgcctggatgcagaatccctggtcaagctgagtgtggacagagtgaacgtgcacagcccgcaccgggccatggcggctctgggcttgatgctcacctgcatgtacacaggaaaggagaaagtcagtccgggtagaacttcagaccctaatcctgcagccccagacagcgagtcggtgattgttgctatggagcgggtgtctgttctttttgataggatcaggaaaggctttccttgtgaagccagagtggtggcgaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcatccatggtccgggactgggtcatgctgtccctctccaacttcacacagaggaccccagtcgccatggccacatggagcctctcctgcttcttcgtcagcgcgtccaccagcccatgggttgcggcgatcctcccacatgtcatcagcaggatgggaaagctggagcaggtggacgtcaaccttttctgcctggttgccacagacttttacagacaccagatagaggaggagctcgaccgcagggccttccagtctgtgtttgaggtggttgcagctccaggaagcccatatcaccggctgctgacttgtttacgaaatgtccacaaggtcaccacctgctgagcgccatggtgggagagactgtgaggcggcagctggggctggagcctccagaaatctgcgccctgtgccctgcctccaccgagccagcttggtccctgtgggcttccgcacatgccgcgggcggccaggcaacgtgcgtgtctctgccatatggcagaagtgctctttgtggtacagtggccaggcaaggagtatctgcagtcccggtggggctgagcctgaggccttccggagagcaggagcagctgtgctgcacgccatgtgggtgaccaggtcctttctcctgatgctcacctgttgggtgttgccaggctgcagctgctcttgcatctgggccggaagtcctccctcctgcaggctggctgtgggcccctctgctgtcctgcagtagaaggtgccgtgagcaggctttgggaacactggcctgtgtcttcctggtggggtgtgcatgccacgccctgtgtctgtatgcacagatgccatggcatgtgctgggccagtggctgggggtgctagacacccagcaccattctcccttctctcttttcttctcaggatttaaaatttaattatatcagtaaagagattaattttaacgtaactctttctatgcccgtgtaaagtatgtgaattgcaaggcctgtgctgcatgcgacagtgttcggggaggtgggcagggcccctggccacgctccctctcctgtagccactggcatagccttcctgagcacccgctgacatttccgttgtacatgttcctgtttatgcattcacaaggtgactgggatgtagagaggcgctagtgtgcaggtggccacagcaggactaaggacaggcccccactgtcctaggggcatgctcgcctgcagcccctccttcttgggcacagacaactgttgttctccacccacattagggacagcagcctccctatcagctgagaaggccagccctccctggctgtgagcagcctccgctgtgtccagagacatgggcctcccactcctgttccttgctagccctggggcggtgtctgcccaggagctggctggccggtgatgggatctgccgttccatggatgcatgccccaagggtgtcactgagctgtgttttgtctgagcctctcttggtcaacagcaaagcttggcgtcttggcactgttagtgacagagcctggcatcccttctgcccccgttccagctgacatcttgcacggggaccccttttagtcaggagagtgcagatctgtgctcattggagactgccccactgccctgtcagagccgccactcctatccccaggccaggtccctggaccagcctcttgtttgcaggcccagaggagccaagtcattaaaatggaagtggattctggatggccggctgctgctgacataggagctggatttgggagctctgagatggggcaggagctctgcttcctcagcccttgaggcgagccaggcgaggttggcgactgtcatgtggcttggtttgctcatgcctgttgatgttttgggtattgaatatggtaagtggaggaaatgcttttctggagtctgtgcaggtgctgccttgagaccctcaagcttccacctgtccctctcctatgtggcagctgaggagcagctgacatgtggacttgtgtgctgcccacatacatgagggggcgctgaaagggagcccctgctcaaagggagcccctcctctgagcagcctttgacaggcctgtatgaggcttttcccaccagctcccaacagaggcctcccccagccaggaccacctcgtcctcgtggcagggcagcaggagcggtagaaaggggtctgatgtttgaggaggcccttaagggaagctactgaattttaacaagaaagccaccattcttccgtattggttgggggctcctgtttctcatcctagcttcttcctggaaagcctgctagaagctttgggaatgaggggaaagttctcagaaccgttgctgctccccacccacctcccctgcagtaagttatgtcaacagctcggagacagaagtatcacaggccagatgttgttctgctagatgtttacatttgtaagaaataacactgtgaatgtaaaacggagccattccccttggaatgcatatcgctgggctcaacacagagtttgtcttccttttgtttacgacgtgatctaaaacagtccttagcaaggggctcagaacaccccgctctggcagtgggtgtcccccactcccaaaggcctgcctgtgtgctccagagatgaatatgagctcattagtaaaatgactttacccatgcgtaagtcaagtacacgtgcacgtgcatatggacacatctgtagttttatacacgcacatctcaagacagagatgcatggcctccaagagtgcccgtgtcggttcttcctggaagttgactttcctcagacctgccaggtaaagttagctgtgtgacgggcgtccaggcgcggggcttggtcagagcagggctcattcatggctcactaggatcccaccggagaaaacggtctccatatcaactctgccgaagggaggaagactttgtcgcgttcctaaaaaacctatggcaagcaccaatcatattatccaaattgtgttgaaaatgtgattaatttggttgtcaagttttgggggtgagctgcggggagactgcttttgttttgctgctggtaatatcaggaaagactttaatgaaaccagggtagaattgtttggcaatgcactgaagcgcgtttctgtcccaaaacgtgcctcccttccgctgcgggcccagctgagtctgtgtaggtgacgtttccggctgccaagcgctctttgttactgtccacccccatttctgccagcacacgtgtcctttcaggaggaaaatgtgaagcggaaacccctccagacacccagaatgtagcatctgagaaggccctgtgccctaaaggacacccccgcccccaccttcatggaggggtcattccagagccctcggagccgatgaacagctcgtcctcttggagctgagctgagccccccacggagctcgggacggatagtaaacagcaataactcggtctgtggctgcctggcaggtggaagttcctccccctgaggggcggagtgaggttagttctgtgtgtctgtggggtggagtcagcctgctcctgctacctgtgagcatcctgcccagcagacatcctcacccggctttgtccctccccacttcctccctctgcggggaggacccaggaccacagctgctggccagggtaggcttggagctgtgctccggaggggccacctgagggagcgagaagaaggaagatcttgagagctgccgaggcaccctggagagctcaggatggtccaggcgagaagaggacactcgctcgccaggcctgggcctcctgggaaggagggagccgctcagagcgctgcatgacaactgaaggcaacctggaaggttcagaggccactcttcccccgtgtgcctgtcacgctctggtgcagtccaaggaacgccttccctcagttgtttccaaaagcagagtctcccgctgcaatctgggtggtgattgccagccttggaggattgtggccaacgtggacctgcctacggagggtgggctctgacccacgtggggcctccttgtccaggtctcattgctttgcgctgtggtcagagggactgtcagctgagcctgagctcccctggagccagcagggctgtgatgggcgagtcccggagccccacccagacctgactgcttctgagagcaaagggaaggactgacgagagatgtatatttaatttttttaactgctgcaaacattgtacatccaaattaaaggaaaaacattgaaacca

SEQ ID NO: 6 - DNA, 13498 bp, Homo sapiens
ttttttttttttttttttgatggtttccatttttttcctttaatttggatgtacaatgtttgcagcagttaaaaaattaaatatacatctctcgtcagtccttccctttgctctcagaagcattcaggtctgggtggggctccgggactcgcccatcacagccctgctggctccaggggagctcaagctcagctgacagtccctctgaccacggtgcaaagcagtgagacctggacaaggaggccccacttgggtcagagcccaccctccgtaggcaggtccacgttggccacgatcctccaaggctggcagttaccacccagattgcagcgggagactctgctcttagaaacaactgaggggaaggcgttcctttgactgcaccagagcgtgacaggcacatgggggaagagcggcccctgaaccttccaggttgccttcagttgtcatgcggcattctgagcagctccctccttcccaggaggcccaggcccggcaagcgagtgtcctcgtctgagccatcctgagctctccaaggtccctcagcagctctcaagatcttccttcttctcactcctacacgtgacccctctggaggacagctccaagtctaccctggccagcagctgtggtcccgggtcctccccgcagagggaggaagcgggggagggacaaagcccgatgaggatgtctgctgggaaggatgctcacaggtagcaagagaagcctgactccacccaccagacacacagaactaacctcactccaccccgcaacgggaggaagttccacctgccaggcggccacacaccgagttattgctgtctactatccgtcccgagctccacgtggggctcatctcagctccaagaggaggagctgttcattggctccgagggctctgaaatgaccccctccatgaagatgggggcgaggggtgtcctttagggcacagggccttctcagatgctacattctgggtgtctggagggggttcagcttcacattttccccttgaaaggacacatgcgctggcagaaatgagggtggacagtaacaaagagcacttggcagctggaaacatcacctacatagactcagctgggcccgcagcggaagggaggcacattttgggaaagaaacacgcttcagtgcattgccaaacaattctaccctggtttcattaaaatctttcccgatattaccagcaggaaaacaaaagcaatctccccacagcccacccccaaaacttgacaaccaaattaatcacatttgcaacaaaatttggataatacgatgggtgcttgccacagatttttaggaacatgataaagtcttcctcccttctgcagagagctgatatggagaccatcttcgccagtgggatcctagtgggcaatgaatgagccctgccctgaccacgtcccacgcctggatgtccgtcacgcggctaacttgacctggcgggtctaaggaaagtcaacttccaggaagaaccgacacgggcactcttagaggccatgcatctccgtcttgagaggtgtgtgtgtaaaattatagatgtgtctatatgcacatgcatggatactttatgtatatgcgtgggtgaagtcatttttactaatgagctcatattcatctccggagcacacaggcaggtctttgggggtgggggacacctactgccagagcggggtgttctgagccccttgctaaggactggtttagatcacgtcgtaaacaagaggaagacaaactctatgttgagcccagcgatatgcattccaagggaatggctctgttttacattcacagtgttatttcttacaaatgtaaacatctagccaggaacaacatctggcctgtgatactgctgtctcagagctgctgacataacctgcgggggaggcgggaggcgggtggggagcagccaacagttctgagaactttcccctcgttcccaaaccttctagcgggctttccaggaaaaagctaggatgagaaacaggagcccccaaccaatacggaatggtgattttcttacgtgttataattcagtagcttcccttaagggcctcctcaaacatcggacccctttctaccgctcctgctgccccgccacgaggacgaggtggtcctggctgggggaggcctctgttgggagctggtgggaaaagcctcatacaggcctggcagaggctgctcagaggaggggctccctttcagctccccctcacgtatgtgggcagcatacaagtccacatctcagctgctccccagctgccacataggagagggacaggtggaagcttgggggtctcaaggcagcacctgcacagagttccaacatttcctccacttaccacattcaatacccaaaacatcgacgggcatgaccaaaccaagccacatgacagtcgccaaccttgcctggctcgcctctagggctgaggaagcagagcccctgcctcgtctcacagccagtcggcaagcagagctcccaaatccagctcctacatcagcagcagcccggccatccagaatccacttccattttaatgacttggctcctctgggcctgcaaacaggaggctggtccagggacctggcctggggataggagtggcggctctgacagggccgtggggcagtctccgatgagcacagatctgcactctcctgactaaaaggggtcaccgtgcaagatgtcagctggaacgggggcagaagggatgctgggctctgtcactaacagtgccaagacaccaagctttgctgttgaccgagagaggctcagacaaaacacagctcagtgacactcttagggcatgcatccatggagcagcaggtcccaacacctgccagccagctcctaggcagacgccaccccagggctagcaaggaacaggagtgggaggcccatgtctctggacacagtggaggctgctcacagccagggagggctggccttctcagctgagtgacagggaggctgctgtccctgactggtgggtggagaacgacagtcgtctgtgcccgaggaggaggggctgcaggtgagcgcacccctaggataatgggggcctgtcctcagtcctgctgtggccacctgcccactaacgcctctctacatcccagtcaccttgtgaatgcataaacaggaacatgtacaacggaaatgtcagcgggtgctcaggagggctatgccagtggctacaggagagggagcgtggccgggggccctgtccaccaccccggacgctgtcgcatgcagcacaggccttgcgattcacatactttacacgggcatagaaagagttacgttaaaattaatctctttactgatataattaaattttaaatcctgagaagaaaagagagaagggagaatggtgccgggtgtctagcacccccagccactggcccagcacaggccatggcatctgtgcatccagacacggggcgtggcatgcacaccccaccagggagacccaggccagtgttcccaaagcctgctcacggcaccttctactgcaggacagcagaggggccaacagccagcctgcaggagggaggacttctggcccagatgcaagagcagctgcaacctggcaacaaccagcaggtgactatcaggagaaaggacctggtcacccacatggggtgcagcacagctgctcctgctttctggaaggcctcaggctcagccccaccaggactgcagacactccctgcctggccactgccacaaagagcacttctgccacatggcagagacacgcacgttgcctggccgcccgcggcatgtgcggaagcccatagggaccaagctggctcggtggaggcagggcacaagggcgcagacttccaaaggctccggccccagctgccgcctcacagtctctcccaccatggcgctcagcaggtggtgaccttgtggacatttcgtaaacaagtcagcagccggtgatatgggcttcctggggctgcaaccacctcaagcacagactggaaggccctgcggtcgagctcctcctctatctggtgtctgtagaagtctgtggcgaccaggcagaaaaggttcacgtccacctgctccagcttgcccatcctgctgatgacatgtgggaggatcgccgcgacccacgggctggtggacgcgctgacaaagaagcaggagaggctccacgtggccatggcgaccggggccctctgcgtgaagttggagagggacagcatgacccagtcccggaccatggacgactgcccggtgctgtgcagagtctgaaacaccttatacaccacggtggccatgaactgggggtatggctgctggttggacagaaactctccgatgactttgttcatgatgtcctggggtgggaagaagtcgtctagaaactggggcaggatcctggccaccactctggcttcacaaggaaagcctttcctgatcctatcaaaaagaacagatacccgctccatagcaacaatcactgactcgctgtcgggggctgcaggattagggtctgaagttctacccggactgactttctcctttcctgtgtacatgcaggtgagcatcaggcccagagccgccatggcccggtgcgggctgtgcacgttcactctgtccacactcagcttgaccagcgattctgcatccaggcgggagagctgctcagagagcaggaggcgctccaggcctctgagggcacagtggtaaatgatggagggggtggactcctcacttccagacagcatcaccccacacatctgtattattgatgctgaaaattccggccctacgtccagaggatagttctcaatgaggtaaaacgcagtggcacacatgaccagtacgtgctgctggctgtgaatgttcacgcagtgggcgatccctttcaggttggagaggagatagtcgctgatgaccgggatgagctgcttggcagtgtcgtccagcaggtcgcactccagcacatagaggacgccgtgcagggctccaaccctgctgggcaggtggctgctcctgagcgtgctctccagcaggcggctgacaggctccgccacggccttgtccatcccaaggacggcagctgccttgcaggtggcaggcaccaggtactgagcgaggatctcgtcttctgaagggtgcacccttcgcagttctgtcagcgtcacatacatcagctcaaactggttgcgctcggtgaacaagtctgagaccactagaagggatctgaccacctcactgatcaggatggccggggtcctcctggctgagctggacggcaggatccagcggctgtacaactcaagcaaaaactgcgaacaggagtggatgtcaactccagcccggtgtttcctggagttgactggagacgtgggtggtgacgaaggtgcaggggcgtcggcctcctcctcctcttcctcgtcccattcctcctccctcaggggtgtgatgctgttccccagccacacggagtgtatggacacctggccgagtttgtagctcatgctccccagctcccgctcggggttgatctgtagcagcagcttctcgtggctgatgagggcacctgtagtagccggagacagagaagggacaggatcccatgcctgatataaatgatgggtggcaatattctctctctttgaaaccattgcttgaatctcttgctccacaatccctctgataatgctcagcttcctcccaaacctggtgtcgagagctttcagaggcttgttccggggctgctgctccaagcagcttacagctgggttgccggccacaggcacagtcattgcactgagcaccagtgaggtgatggcctgcacggccaggacgttgatctgggtcctctctgtgtcttcttctggtgggctctcctcctgctccatcacgaggggctgcgtcaccaggacaccaaggagggtggcccaagtttcttcaaactgagtacgactggtccagcctagtgtgttgatgcggtagatgaactccttaaagacttccttttcctggaggaactccacggggatctcagggaatgctgtgccaaaatcccctcccggtttgggtgaccatccaagcttccacaccagtgggggcacacgtgtgtagctgttgacaaggggcaggcgggccaggctgatgatgatgttccttagcaatggcgtgagaaacgccggcacgccgctattccttttatgacccaaggccaacaccgactgcagagactccaccatttctgccaccatctcacaggctgcagtgatatacttaggattctgtgtgtttggatctacttcctcctcctcctcgctgatggcttttggggtatttgtccttctttctggactaagaagctgctctccaggctgcactgcaacggcctccaggatgaagtgcacacagtagatgagggagcaggcgtgggtcacaaactctgtggaggagaccacgctccagaggccaggcagctgcagggccaggcagcagcagtccagccctgcctggagatccagactcagcgggatctgctcatggatcaaatgccaggacagggcctcaagggttgccaccacgaatttcacaatgtccttctctttctcaggaggaaggtgcaaatgactgggcagtttggagaccaccaccaggtactgtgccagggcccgggccagagtgggcagggactgatacagtgcagcatccccaaacagatcattcaacttgctccagtaggccgccggctctgcaggcagctcgggctggaagacatgatggacagcagggagctgctgcacggtgccgctcacacgggccagagtcacctcacgggctgcttcaaaaagggcactcttctggccaccagaaatttcactcatccctaggcttaagcatggagctagcaggcttaggttgaactccgagttcatcatgaaggcattcatatcttcagcaggaatccgattcaccagctctgcaccttccagcagtgcagaatctgacctggtccaacactgggatttgacaagatgaacgtaccagtctttgtccggactcactgtttccagtgacacgtgcccatccccgtccagcgggtgggaagagactggaggagagggactaagtgagtcttgcatggtggagagacgaaacctgtccagcagggaatagagcctttggtgtctctgagcgagcccgctgctctgaaggtattcctggattctgttgagttcttccattggcaactgggccatgctgctctgtaaatttgcagccagaagcatttctacccggcgacaagcaaggatgtcgaccatgcgagccagcacacggaaaggggtgcacagaagcctgtccacatacagcgtgagcacagctcccgactggctgagatggatcccctccaagcactgaagagttttcttcagcatggttggagttgaaaggttttcacaacgagactgaattgcctggatgaacaggccgctggcagcagagttccgatgaacggcactgatgaagtcctgtactggaggctcgtgggaaaggctgatcagatcttgaatgtgatttacaatgagccacgttaagtgctcggagtcatggaggttctgacagacataatcacagaagagaatgagagcccctcttcgtactatttctctattgcacattccaagtttggctgccaagtcagaatcctcctcttctccagacatctggggactaagtaactttgtgctggacagactgtgtcttttcggggtctgctgcacttctgcccaccagcggtagtcggtgtggttgacaagcagcagtatctgacaccagagcagcaccagggccgggtgggtggtgatcatggaacgagcccgcaagttcaagctgtccagggtgtagaaactgccgccacagccatcactgcggaacagcctagtggcagctgctgtgattctccggaacattccagacttgaagatgtggatcagacacattagcagtgtgcctagttcctggcaatagaaagtatgttgctgctcactcatttccaccttcagctgttttgtaacaatgtcttctaaaagaataccaaccagttgtaatagaaaccttgaaaatgtttcttctggcaaattctttatttgtttcccttcactgtgttcttctagcgttgaagtactgtccccatctcttaacctattaattactgtacaggagattaaatacggagagaaggagagctcctgaatacgagaaagaacaatatcttcagttgactgggaaatcagaaccctcaaaatggccagaattcccgatatccacagttgaacagtgctcacggacgccattgtgtttggagtgacgaacatactccgtaaaagcatgtctaccggacggagggaggaaggggccaaaatctcaaataatgtatttaacactccaagggcttcatgagagtcaatgtgcatctgctgtttggctaacattgggaggatgatgtcagctatctgtcgagacagtcgcttccacttgtcttcattctccttgtggcactgctgcaggacaagaatgaacatctccaacacctgatggtactggatgagtctcagtaacattgacaccaccacctctttttgggtttcaagctcttttcctgcatcagctttatttgttcctcttaatacaaagaggtcgtggactatgggctgcagagccggtatggcatgtgtcacagccttccttccactggccatgatgccatcacagagctgaatgattttaggaattccaatgatctgttttgaatgatagcgttcataagatagtaataccaagaagaaaaagatgtttggaatgattgcctctgattccctgaactggcccacttcaatgtattcaaactgtttcaatacaaagccaataaacacctgatctgaatccagaagacagtaattaacccgtaactgaaccagctgcgccagcaaatctaaaacctgcttctgtaactgcacacatgttgtagtcgtgtactgttttaaagcttttataacaagaggttcaaacaaacgaatgtgattatgaatagcattcttatctgcacggttctttgtgacactcgtgaggtttgtcttcaactgggtagacactttctggaggacatcaaaccatcccgaggtgtcgttctcctgctccgcctgcaccatgttcctcaggctggcgtcagcgagggcctgggtgaagtgggtgtacggggccatgaagcagtagtggtacaagcctggcctcacactggaggagccaaggcgctgtgctcggccttgtgacttgctggggttggaagataagccatcaaactgggaggccaagtttgtgccaaagagagtcttcaacaattgttgaacacaaacagttgccatcattggttctcgactaaagcaggatttcaggtatcctaggatctcttcaacacacttcccaatgtcctgcagtgtggccagctctagtatctgagaaagaacatccaaggctgagcggagaaaccctccaaacttttccgtgctgttctgaagatccagcgtgaccttgtagttagcgtgtgtagctttcaggacatcatgcagtttgaggtatgaaggaagatgatagaaactccccagtgatgaggatttacttgttgtaacaggacctgaggtatcagattgtctagaagctgcactggcctcactgcctttcttgggactcaacggtacagatgcttgttctcctggttctttctccttcccctttcgtcggatgggacttagagaaggggggtttgttagagaaggcaaggctgcctttattgcgggtccaggagccacgtcatccaggacgtgggcacaaatgttaatcaccttcagcaggtgagagaagagctgctccaccatgggcaccagggcccggtcccccagggctggccagacctcctcttgcttggtggctgctgggttggcttcttcttcagaggcccatgaacttctcagagatttgggagcactggctgcaagcaagtttccggccaaaatcaaagcatcttgatgggctgagagatccaatgggaaccaagctgacgagagcagggtcagaatcattgtggccatcccaacggtacagctcttcctagactcatctgaggcactcagtggaggcactccacagtgccaacctaaactccaaatgcaaactgggaaggcagtggaaagaagacacaaagcttcacagcatccaaatgtgagtgctctggtggttgatgtgattagttcatgagaaactgctgcaataactcttgaaaggttattttccatagtgacgtctgttatgcttggtagtaggttatagcctctatatattctggttattgtgctgacggagaaatgagatggaggctgcgtctcatgcatgagaagtttcaggtaaacactgctttgatctcttgccacggccactactggatcagcttgtccttggtcacatttataaaacagctttgggacaagcctaattagtgatgctgcggcaacatgtcgcaccctggggtcttcatctccaagcaaatggatgacaacattattgagcactcgttcttgcagttttaaaagccctgtataatgatgagcccctctgtgtaagttttctgcttttgcctccaaaaagctcaccagcctgaagtcaatctctgcaagggtttccagaagctctgtcctcaccagccaataggaactgttcctcagagtcagcacatcgatgatcagctgcagtcctaactcactgtagctgctgctgcagagactcatgacacagttcctcacagctgtacaagctaacttgcaagtaacagaagactcatccttcagtgttttccgcagcaaaggaatgcaatccgccaaagaaaatgtatttcctgtgagggttctaatggtgcccatccaatctcccacgtggaagcgggacctgctgaggatggagcagatgagggtcccacagagaatggcagtggctcctcgaacctgtgggtctccatgatcgatgtagttcaagatgtctgagacatactgttcctcagggtattccgtggtgtcaagaggaactttatagagtttgctgaagaaagattccgggtggagggccacagctgctcccacacagctgagggccagggccttcacgctgaccctcacatccctgtccggaaccagcacattttttccccctgttagcaaaaacgaagcagataaaaggcggacacaatggacaagaggtgcagagtcatcatcagtggactgtccaatgtcacctttgatgcggcaaggcttgttttcttgatcacccggttcagtagcttcatctctcaacacaaatttatcaacactgctgtcagaaggctgcctgcagtgactcatgtttttcaataaatgtgcctgttgaagggccatggaagagttcctgaaggcctccgaggcttcatcaggaagaatacctgtggcttcctcatcttcatcctggggctgtccaatctgcaggcccaaatactggttgtcggtaccgtctaacacaatttcagaactgtctgaaggggtaacagctgaatcaggcccttcggtggtggtctgggagctgtcgctgatgggcgacgaggcctgggtcccatcattcaggtccatggcagggtcagatgggacggcgctgacctggctggagctgtggctcaagatatcctcctcatccccatcagtggcagagcttgtcaagtcacagctggccagatccactgagtccgcctgcagtgtgtgctgtgaccgtggctgttctgtgatgatgtcatgacctgctgaccctggagtggaaacccctgaagaagcagccagctctccactgatctcatccttcactgaggctgttaaggcagagctgctgacatccgatctcgattcagagtcatcctccaaggcttcttcttctcctaagagcactttgcctttttgttttcttgaaaggacagggctgcatgaggaaccccctccagctataagttccacaatactcccactacggcttcggccaccagactcctccttagcagcggtgagctgcccaatgcccccgactgcggtcagggtttgcagaagctcgggtggaggcgttctgaagagctgctgcaacagctccagggctccggtcacaacattgtggtcttggtgctgtgtatgatgtaacgtcagttcataaacctggacaagctgctctgcagaaggagagacttccatttctttccttgtcactccgaagctgcctttcaggcttgtgtccttgacctgctgctgcagcaagggcaccaaatacctcagggtgagcagcacgccaagaatcagcagagtggagtgttcatcctcgacaggaacgagtaagcctaagagcacatttagtagccaactatagaaatattgtgtccttcttgagtgctggcagatgctcactgctgatccagccgctgtccgccgaatggtgggggagcttgacttcaggttcgctatgaaggcctttaacaaaaccttaatttcattgtcatttgcaaaattgccaaaagaagccataattttgggaacagctgcagccaaggtctcctggactgattcttcgggtctcttgcttgttcgagtcaggcacggcagaaggttcaccaggtaaggcctgcatttctgaggccgaaccaggtgagccagctcagcaaacctccacagggcagcacgcaaactccgaggggcaccattctttttaatttccttatagagctcgagctgtaaccttggaagattagaatccatcaaagctttgataactttgttgaggcattcgtcagccaccatcctgacatctgactctgcgtcatcactgcacagcagaaaaagttccatagcgatgcccagaagtttctgaaattctggagaatttctgacagactgtgccactatgttttcacatattgtcagacaatgattcacacggtctttcttggtagctgaaagttctttctttggtcggtgcagcggctcctcagccacagccgggccgggtggcggcgggggcggcggcgggggcggctgcggctgaggcagcagcggctgtgcctgcggcggcggctgaggaagctgaggaggcggcggcggcggcggcggcggtggcggctgttgctgctgctgctgctgctgctgctgctgctgctgctgctgctgctgctgctgctgctgctgctggaaggacttgagggactcgaaggccttcatcagcttttccagggtcgccatggcggtctcccgcccggcacggcagtccccggaggcctcgggccgactcgcggcgccgctcagcaccggggcaatgaatggggctctgggccgcaggtaaaagcagaacctgagcggccgtccatcttggacccgtcccggcagc

SEQ ID NO: 7 - DNA, 13237 bp, Mus musculus
ttttttttttttttttttaacagcaacaacaggtggtttaatcgcttctttaattcaactgtacaatatctgcaatttaaaaattttaaatatacatttcatgtcagtccttccttttggaaatggacagccaggtctaggctgggctccggggcacacccatcacagccctcctagttcccagtgaagcccatggcatacagcagcaaggcttggacaggagccccctagaatgcagccaaatctctgcagataggtctctgccacctattatcttacacccagcttgcggcagagggtgtttccagagacacttgaggggagcagttccttcgatggctctagagtgtgacaagcacacatggagggtggccctgaaccttgatatcatctttagttgtcacactgctcagcattggttcttctttcctggaggctccagacccactgaggaacaattcttttcccaaccatgatatcctgagcccacacccagcatcagcagctcagtgtcttcgactcccacataccaatccctggaggacagcttcatgcctgtcctggtagcagccatgatcctagtgctcaatgctgagggagggagggagggacggagggagggagggagggagggagggaaggagggagggaaggagactgtgtggggaaggatgctcacaggtggcaaggagaccaattctgcagccccacaatgggaggcaagactccttgtgacgtggctgtgagacaagctattgctgtataaaacctgtcccatgagccggaagcagagctgcttcactcactcacgggaaggtacttcctgccagggaaggcacctgttaggattggtcccttccctggcactgcattctacagggcaggaggtggttccactccagttcttccctcctgaagggtacatgtgcagacaaaatgagagaaccataaagggcacttggcagtggctaagtcacctacatgtcaagggggccatcagtgggagggagggaggcacattttggagaagaaacatgctgaagtgcattgccaaaagttctaccctggttttattaaaatctttcctgacagtaccaccatggaaacagaaacaacatcccacctcctacccctaaaacctcatagtcaaaataacttttgtttttaaataaagcttggaaatctttagatttttgaggaatttgataaaaagttttagtccctcctgcagttagacaggtggggcaatgtctccagtgagactttaatgagctatggacttttaaaaattgagtcccattctcagatgctagactcacaaagctgactgtatgtggcagttgcaagaaaagtctgctttcagaaaaaacaggcaggcatttttagaggccttgcatatgtctttgaggattgtgtgtgtgtttatgtgtgtacacaaatacatacctgcctgtacccaggtgcatctctaggttgtggcacccatgagcagacaacaactttgtggcagaggctgtccttgccccatactaagaattgtttctgatcacactaaacaagaggccaactaaacttgaggttgagctcactgatataatcccctggtgaatggctctagattttatattgagtttccttatgaacatctaccatgaggagtaatcaggcctgcaccatgctcatctcagagcggttggaccaacctcagagtgtggcagcagcactgtaagaactttcacatggtccccgagcacttctaggcgggaaattgagggtgacaagaagaagccctaaatcagcaaaggggcattggtgaatttctttcattaaaattcagtagcttcccttaacgtcctcttgaaagacctaatccatgtccactgttcctgttaccacgccttggggtggtttttgccagggcagataggaggagagtcaggccaagtgtgaggctccccacaacctgtgtttggtagggaaccttgcatcccagcagcaaggctacttgtcatgatggaaagatagagggaaattcaagggtctcaagaaagcaatccatggactgaagcacagttagttaatcacaggctgcaagctctttcctcctgtgtagcctagaaacatctccaaactattccactcccctactctacagctgagaaatacagatatgacttagcggaacagcagaaaatctgcttggtcatatagtcaaacagcaaacagagttcccaaaccaagccaggaaatgaaggtagctcattttcattaacatgacctggttactctgggcttgggctttgggaagaggtggctctgaccagcatgggaagctgtctgaggccagaggctgacctgattttgaaccttccctttggtgcctcatcttgtcagctgagtcctccctgggctctgacaggcataggtctgtactctactgggctgacagaaggcaagatgggaaggggcaaaagaggctctgggtccattcttaactgttgctaggacaccaagctttcccttgactatgagaaactgagacaaaccaacaaaccatagctcagagacacctttggggtaatcaggtcagcacttctcaggtcccaaccatgcagaagatacaaagggacagacagcatccacaatggtcagctggtgtgtgggcaggctacagtgcaggtcagccacaaccagggatgaggttattgggatagccactttgggtccagcagatgctgtttctacccaggctgagagactaggagagtgcatcaacaccagggaggagatagcttgacagtcatgcctgggaaggggagaggagggcagctgccacagggcaagcctcttataactctaacagtggaagtcagtttttcagttcctcagttaggccacaggcaggattctcacacaggcagtcaataccaacacctctctctgtgctggcttaatggaatgcataagaaaagggagctgtatgaagtgcaagtgccacagggtgttgggagggctacaggagggacctgcccgactagactgagtagctacaggagagggagtggcggccagaaggcccctccacttccataaactttgtcacatgcagcacaggccttgccaagtcacacactttacacgggcataggaaaagttacattaaaattaatctctttactgatataattaaattttaactcctgagaagaaaacacagaaaggaaaatggtgctggacacctggcagccccagttcccagccccacacaccattcattttgtgtccagacactggtgtggcaggtatgcctactgggtaaatgtgggagggagctctccagcccagtggagcaggcgggctcagaaccatctggcaagagctaggacttctgatccacataccagggcagctgcaacctggcgactatggccaggggaacactaggaaaaagacaaacacctggtcaacctagcactgtcaccagctgcagcgaggccaggacccaggactcaggctcaaccccaacatagtgcatgttccctgcatagccctcattgcaaagcactcctgccattgcctggctgtccacttgacacaagtggaagcctgcacggccaaggcagccccagcagaagcttggagcaggctcctggaggctcaggccccagcagctgccttctttcagccttttgtcccacaggcactactcagcaggtggtgaccttgtgaacattttgcaaacaagcaagcagcctgtggtatggacttcctggtgcagccaccacctcaaacacagactggaaagccctgcggtcgaattcctcctctatctggtgtctgtagaagtctgtggcaaccaggcagaaaaggttcacatccacctgttccagtttgcccatcctgctgatgacatgtggaaggatcgcagaaacccatgggctggtagatgcgctaacaaggaagcaggagaggctccacatggccatggcaactggagttctttgtgtgaagttggacagggacagcatgacccagtcccggaccatggatgactgcccagcactgtgcagagtctgaaaaaccttgtaaactacagtggccatgaactgtgggtatggctgctgattggacaggaactctccaatgactttgttcatgacatcttgaggtggaaagaagtcatctaggaactgaggcaggatccttgccacaaccctggcttcacagggaaatcccttgcggatcctatcaaagagaacagacactcgctccatagctacaatcacagactcgctgtcaggtgtagcagggctggggtcagaagctctgcctggactggctttttcctttcctgtgtacatgcaggtgagcatcaggcctagggctgccatggccctgtgtgggctttgtacattcactctgtccacacttagcttgaccaaggactctgtgtctagccgagatagctgctcagacagcaggagccgctccagaccccggagggcacagtggtaaatgatggagggggtggactcctcacttccagacagcattactccacacatctgtatcacagatgctgaaaattctggtcccacatccagagggtagttttccatcaggtagaaagcagtggcacacattaccagcacatgctgctggctgtgaatgttcacgcagtgggctattcctttgaggttggacagcagatagtcactaacaactggaatgagctgctttgcagtgtcatccaagaggtcacactccaacacatagaggatgccgtgcagggctccgatctggctgggcaggtggctgctcctcagtgtgctctccagtaggcggctgactggctctgccacagttttgtccattccaaggacagcagctgccttacaggtggcaggcaccaggtactgaatgaggatctcatcttctgaagggtgcactctccgtagttctgtcagcgtcagatacatcatttcaaactgggtacgttcggtgaataagtctgacactacaagaagagatcgaaccacttcactgatcaggatgacgggggtccttctggctgcactggatggcaggatccatcggctgtacaattcaagcagaaactgcgaacaggagtgaatatcaaccccggcacggtgttttctggaattgactggagacacaggtggtgacgttggtgcagggacatcactttcttcctcttcttcctcatcccattcctcctctctcaggggtgtgatgttatttcccagccacacggagtgtatggacacctggcccagcttgtagctcatgttgcctggctcccgctctgggttgatctgcagcagcagcttgtcatggctgataagagcacctgtagtagctggtaacagagaagggacaggatcccacgcctggtgagaatggtgagtggcagtattctctctctgggaaaccatctcttggatttcttgttctacaatccctctgatcatgctcagctttcttccaaatctggtatcgagagccttcagtggcttgttccggggctgttgctccaagcagcttacagctggattgccagccacaggcacggtcattgcactgagcactagagaggtgatggcctgcacagccaggacatggatctgggttctttctgtgtcttcctctggtgggctctcttcctgttccatcaccaggggctgagtcaccaggacaccaaggagggtggcccaagtttcttcgaactgggtacgattggtccaccctagggtgttgatgcggtagatgaactccttgaggatctccttctcctggaggaactctacagggatctcaggaaacactgtgccaaaatcccctccaggcttgggtgaccacccgagtttccataccagaggaggcacacgagtatagctgttaactagggggagtcgggccagactgataacaatgttcttcagcacagctgtgagaaatgaaggcagggtgctgttcctcttgtggcccaaggccagcactgactgcagggattccaccatgtctgccaccatctcgcaggccgaagtgacatgactgaggttttgtatatctgagtctacttcctcctttctgacagctcttggagtatgtgacctgctttcaggaccgagaagctggtctccaggttgtactgcaatggcttccaggatgaatcgcacacaatggatgagggagcaggcatgagtcacgtactctggggaggacagcaccccccagaggccaggcacctgtagtgccaggcagcagcagtctagcccggcttggaggtccagactcagtgggatctgctcatggatcaaatgccatgacagggcctcaactgtcattaccacaaacttcaccgtgtccccctccttctcaggaggaaggtgcaaatgagcaggcactttggagagcaccaccaggtactgtgccagggcacgggcaagtatggtcagagactggtatgatgtggtatcaccaagcagatcattcaacttgttccagtaggccgtgggctctataggcaggaagggctggaagacttgatggacagcaggaagctgctgaacaacactggtcacccggttcagaatcaccccacgggctgcttcaaagaggggactcttttggccattagcaatctcgctcatgccaaggcttaaacagggagccaaaaggcttaggttgaactccgagctcatcatgaagtcattcatatcttcagcagggatacggttgaccagctctgcaccttccagcagtgcagaatctgatctggtccaacactgggatctgacaagctggaggtaccagtctttgtctggactcactgtttccagagatgtgtgcccatccccatccagtgggtgggaagtgactgggggcaaggggctaagtgagtcctgcacagtagagagtcggaatctgtccagcagtgaatagagcctttggtgtctttgtgcaagcccactgttctggaggtgttcttggattctgtttagttcctcctctggcaactgggccatgctgctctgtaaatttgcagccaaaagcatttctacccggcgacaggccagggtgtcgaccatgcgagccagcgcacggaagggggtgcccaggagcctgtccacatatagtgtgagcacagcaccagactggctgagatggatgccttccaagcactgaagtgttttcttcagagtggttggcgttgaaagattttcacagcgagactgaattgcctggataaaaagaccactagctgcagaattacgatgaatggcactaataaagtcttgtactggaggctcatgagacaagctgatcagatcttgaatgtgattcacaatgagccatgttaagtgttctgagtcatggagattctgacagacataatcacagaagagaataagggcccctcttcgcactatttctctattgcacattcccagctgagctgccgagccagaatcctcctcttcgccagacttctgggggttaagtgacttcgtgcaggacagactgtgtctcttgggtgtctgctgcacctctgcccaccaccggtggtcagtgtggttgatgagaagtaggatctgacaccagagcagtaccagggctgggtgcgtgggcaccatggatcggacccgtgcattcaggctctctagagtatagaagctgccttcacagccatcactggtgaagagtctagtggcagctgctgtgattctccggaacattccagatttgaatatgtggatcagacacatgagcagtgtgcctagctcttggcagtagaacgtatgctgctgttcactcatgtccactttgagctgttttgtaacgatgtcttctagaagaataccaaccagctgtaaaagaaaccttgagaatgtatcttctggcaaactcttttgtttcccttcgctgcattctcctagtgttacattaccgcctccaccccttaacctgttaatcactggacaggagagcaagtgtggagagaaggagagctcctgaatacgacaaagaacaatgtcctcggttgactgggaaatgagaaccctcagaatggcgaggattccagatatccacagctgcacagtgcttacagatgccattgtgcttggagtgatgaacatactccgcaaaagcatgtccacaggacgtagggaggaaggagccaaaatctcaaacaaggtatttaacactccaagggcttcatgagagtcaatatgcatctgctgcttggccaacatgggcaggatgatgtctgcgacctgccgagagagccgtttccacttgtcctcattctccttgtggcactgctgcaggacaaggatgaacatctccagcacctgatggtactggatgagtcgtaacagcatggagaccaccacctccttctgtgtctcaagctctttccctgcatcagctttatttgttcctcgtaacacaaagaggtcatggacaatgggctgcagagcaggtatagcatgtgtaacggccttccttccactggccatgatgccatcacacagctggatgattttaggaattccaatgatctgttttgaatggtagcgctcataagacagtaataccaggaagaaaaatatatttggaataattgcctctgattccctgaactggcccacttcaatgtactcaaactgcttcagcacaaacccgatgaacacctggtctgaatccagtagacagtaattgacccgtagctgaaccagctgtgccagcaaatccaaaacctgcttctgcaattgtacagatgttgtcgtggtgtactgcttcaatgcttttataacaagaggctcaaataacctaatgtgattatgaatagcattcttatctgcacggttctttgtgacgcttgttaggttcgtcttcaattgggcagacactttctggagtacatcaaaccaccccgaggcatcacgctcctgctccgcctgcaccatgttcctcaggcttgcgtcagccaaggcctgtgtgaagtgcgtgtatggtgccatgaagcagtagtgatataagccgggcctcacacttgaagagccaaggcgctgagctcggcactgagacttgctggggttggaagataagccatcaaactgtgaggctaagtttgtcccaaagagagtcttcaatagctgctgcacacagacagttgccatcattggttctcgactaaagcaggatttcaggtatccaaggacctcttcaacacactttccaatgtcctgcagtgtcgccagctctagaatctgagaaaggacgtccaaggcagagcgcaggaaccccccaaacttttcagtgctgttctgaagatctaaggtgaccttatagttggcgtgagtggctttcaggacatcatgcagtttgaggtaggaggggagatggtagaaactccccagtgaggatgatttacttgctgtgacaggtcctgaggtgtctgattgtcgagaggctgcactggcctcaccaactttcttgggactcattggagtagaagcttgttctccaggttctttctccttccctttccgtcgaataggacttagagaaggggggtttgttagagaaggcaaggctgccttgattgctggtccaggagtcacatcgtccaagacatgagcacagatattgatcaccttcagcaggtgggagaaaagctgctccaccaagggcactagagtccgatcccccagagcaggccagatttcctcctgtctggtggctgctgagttggcttcttcttcagaggtccatgaacttctcagagacttgggggcactcgctgctagcaagtttccagccaaaatcaaggcatcctgatgggctgagagatccagtgggaaccaagctgatgaaagcaaggtgagaatcatggaggccatcccaacagtgcagctcttcctggactcatcagaggcactcagtgggggcactccacagtgccatcctaaactccaagtgcaaactggaaaggctgctgagagaagacacaaggcttcacagcatccaaatgtgagtgcccgtgttgttgacgtaatgagttcatgagaaactgcggcaacaactcttgagagattgttttccatggtgacatctgttatacttggcagtaagctatagcctctatagattctggtgatggtgctgacagaaaagtgtgatggtggctgggtctcatgcatgaggagcttcaggtagacactgctctgatccctcgctacagccacaactggatcagcttgtccttggtcacacttgtaaaacagctttgggacaagccttgttaatgatgttgcagcaacatgtcgaaccctggggtcttcatctccaagcaaataaatgaccacattattgagtactcgttcttgtagttttagaaaccctgtataatgatgagcccctcggtgtaaactttctgcttttgcctccaaaaaactcacgagcctgaagtcaatctctgccagagtgtccagcagttcggtcctcaccagccagtaggagctgttcttcagaggcagcatatcaataagcagttgtaatcccaagtcactgtagctgctgctgcaaagactcaggacacagtgcctcacagctgtacaagccaacttgcaagtaacagaagattcatccttcaacgttttctgcagtaaaggaatgcagtccaccagagaaaatgtatttcctgtcagggttctgatgttgcccagccagtcaccaacacggagacgggacctactgaggatggagtagacaagggtcccacagagaatggcagtagctcctcggacctgtgggtctccatgatcgatgtagttcaagatgtcagaaacatactgttcctcagtactttccgtggtattaagaggtactttgtacagtctgctgaagaacgactctggatgaagggccacagccgcaccaatgcagctgagggccagggccttcacactgactctcacgtctctgtctggaaccagtgctttcttttcaccagttaacaaaaaggaagcagataaaagacggacacaatgtaccagaggagcagaatcatcatcattaggctgtcctatgtcacctttgattcggcaaggcttgctttctggatcactggcttcagcaacctcatctcttgttacatacttatctatactgctgtcggaaggctgcctgctatggcccattctttccaacaagtgtgcctgttgaagggccagagaagagtttctgaaaacatctgagacttcaccagaaagaacacctgcagctccctcctcatcgtcctcctgtggctgtcctatctgcatgcctaaatactggctatcggcaccatctaacacaatttcagaactgtccgaaggagtcacagctgaatcaggtccttcagtggtggtctgagaactgtcactgatgggtgaggaggcctgggtcccatcattcaggtccatggcagggtcggatgggacagcactgaactggctggagctgtggctcaagatgtcctcctcatccccatcagtagcagcactggtcaggtcacagccggacaaatccacagagtctgcttgaagtgtgtgctgggatctaggctgctcagtgatgatgtcgtgaccaacagaaccaggagtggaaacacctgaagaagcagcgagctctccaccaatctcactcttcacagaggctgcaaaggctgagctgctgacatctgacctggactccgagtcatcttccaaggcttcttcctctcctaagagcactttgcctttctgctttcttgagaggacagggctgcacgaggaaccccctccagctaaaagctccacgatgctcccgctgcggcctcggccccgggcctcttcttgaaccagagtgagctgcccaagccctcctggtgtggtcagtgcttgcaggagttcaggtggaggggtacggaagagctgctgcaggagctccagtgcccctgtcaccacattgtggtcttggtgctgagtatgatgcaaagtcagttcataaacctggacaagctgctctgtagaaggagagacttccatttctttccgtgtcaccccaaagctgccttttagacttgtgtccttgacctgctgctggagcaagggcactagacacctcaatgtgagcaacacaccgaggatcaggagagtggagtgctcttcttccatgggaaccagcagacctaggaggacattaaggagccagttgtagaagtactgtgtcctcctagaatgttggcagatgctcacggctgagccggctgctgtccgccgcacggtgggagagcttgacttcagatttgctatgaaagctttcaacagaaccttaatttcattgtcatttgcgaaattgccaaaagaagccataattttaggaacagctgcagccaaggtctcctgaactgattcctccggtcttttgcttgttcgggtcaggcatggaagaagattcaccaggtaaggcctgcacttctgaggtcgaaccaggtgagccagctcagcaaacctccacagggcagcacgcaaacttcgaggagcaccattctttttaatttccttatagagttctaactgtagccttggaagattagaatccatcaaagctttgatgactttgttgaggcactcatcagccaccattctgacatctgactccgcatcgtcactgcacagcagaaacagttccatagcgatgcccaagagtttctgaaattctggagaatttctgagagactgtgccacaatgttttcacatattgttagacaatgattcacacggtctttcttggtggctgagagttccttctttggtcggtgcagcggttcctctgccggacctggcagcggcggtggtggcggcggcggctgcccctgaggcggcggctgagggggttgaggcggaggcggcggcggcggtggcggcggcgcctgcggcggtggctgctgctgctgttgctgctgaaacgacttgagcgactcgaaagccttcatcagcttttccagggttgccatgacggcttcctgcccgatgggacagaccctgaagacttggagcctactggcactacgcggcgccacttagcagcaaggcaatgaatggggctctgcgcggcaggcagaagcggaaccaaggcgctcagccatcttgggcccgtcccggcaaccctcgcggcgagtgc

SEQ ID NO: 8 - DNA, 13189 bp, Rattus norvegicus
aacagcaacaacgggtagtttaattgcttctttaattcaaatgtacaatatctgcaatttaaaaattttaaatatacatttcatgtcagtccttcctcttggaaatggacggccaggtctaggctgggctccggggcatacccatcacagccctcctagttcccagtgaagcccatggcatacagcagcaaggcctggacaggagccccctagaatgcaggcaaatctctgcagataggtgtctgtcaccttacacccagcttgtggcagagggtgtttccggacacttgaggggagcagttccttcgatggctctaaagtgtgacaagcacacatggaggtggccctgaaccttcatgtcatcttcagttgtcacactgctcggcattggttcttctttcctggaggctccagacccactgaggaacagttctcttccaaaccgtgatatcctgagcccccacccagcctcagcagctctcagggtcttctactcccacataccaatccctggaagacagcttcgtgcctgtcctggcagcagccatgatcctagtgctcaccgttgagggagggagggagggagggaggcaggcaggcagtggggaaggatgctcacgagaggcaggaggagactaattctgcagccctacaatgggaggcaggactccttgccaggtggctgtgagccaagctattgctgtataaaccctgtcccatgagctgaaagcagagctgcctcactcacaggaaggtacttcctgccagggagggcacccgttagggtcagtgccttccctggcaccgcagtctacagggcaggaggtggttccactctagtccttccctcctgaagggtacatgtgcagacaaaatgagagaatagtaaagggcacttggcagtggcaaagtcacctaatgtcaaggggccatcagtgggagggaggcacattttggagaagaaacatacttaagtgcattgccaaatagttctaccctggttttactaaaatctttcctgataataccagcaggaaaacagaaacaacatcccacctcctacccccaaaacctcacagtcaaaattacttttttttttttaaataaagtttggaaatccatagatttttgaggaatttgataaaaagttttagttcttcctacagttagacaggtggggcaatgtcttcagtgggactttaatgactatggacttttaaaaattgagtcccattctcagatgctagactcacaaagctgactgtatgtggcagttacaagaaaagtctgctttcaggaagaatggacaggcatttttagaggtcttgcatatgtctttgaggtgtgtgtgtgtgtgtgtgtgtgtgtgtgtgcgtgtgtgcgtgtgtgcctgtgcccaggtgcatctctaggttgcagcacccatgagcagacaacagctttgtagcagaggctgttcttgtcccatactaagagttatttctgaccacactgaacaagagaccaactaaactggaagtcactgatataaaccccaggtgaatggctctagattttatattctgttttcttatgaacatctaccatgaggagtaatcggtaatcaggcctgcaacatgctcatctcagagctgttggaccaactttagagtgtggcagcagcattgtgagaactttcatgtggtctccaagcacttctaggagggatatctagggtaacaagtagaaaccctaaatcagcaaaggggcattggtgactttctttcattaaaattcagtagcttcctttaaggtcctcttgaaagacctgatccatgtccactgttcctgttaccatgacaccaggatgggctgggctggcttgcagtggcctttgccagggcagataggaatagaatcaggccaagtgtgaggctccccacaacctgtgtacctgtgtttggtagggaaccttgcatcccggcagccttttaatcatcatgatgggaaaacagaaggaaattcttaagaaagcagtccacagactgaagcacagttaattagtcataggctgcaagctctttcctcccgtgtagcctagaaacagctccaaattactcctctccccactctgcagtcgattggtacagacaggactgagtgggcagcagagagcccgctcagtcacacagccagcagagctcctggaccaagccaggggacgaaggcagcctgtgtccagggctcattctcatcaacatgtcctggctactctgggcttgggccttgggaagaggcggctctgaccagcagcacgggaagctgtctgaggccataggctgacctgattttgaaccttccctttggtgcctcatcttgtcaggccgagtcctcccttggctctgaaaggcataggtctgtactgtaagggctgacagaaggcaagatgggaaggggcaaaagaggctctggttccattcttaattgttgctaggacattgagctttcccttgaccaagagaaacggagacaaccaacaagccatagctcagagacacctttggggtgatcgggctagcattcctcaggtcccaaccatgcagaagatacaaagggacagagagcatccacaatggtcagccggtgtctgggcaggctacagcccaggtcagccacgaccagggatgagattattgaaatagcctctttgggtccagcagatgctgtctctgcccaggctgagagactaggagagtgcatcaacactagtgagtagacagcttgatagtcatgcctggggtaggggtgggggtctgccgcagggcaagcctctcttaatcctaagtggaagtcagtctcataagctgggccacaagcaggattctcacatagggcagttaacaccaacaccactctgtgctagtcaaatggaatgcataagaaaaaggagccgtgtgaagtgcaagtgccatagggtgttgggagggctacatgagggacctgcccgactagactgagtagctacaggagagagagtggtggccagaaggcgcatccacttccataaactttgtcacatgcagcacaggccttgccaagtcacacactttacacgggcataggaagagttacattaaaattaatctctttactgatataattaaattttaactcctgagaagaaaacagagaaagggaaaatgatgctggacacctggcagtcccagttcccagcccccacaccattcactttgtgtccagacactggtgtggcaggtacacctgctgggtaaatgtgggagggagctctccagcccagtgggacaggggggctcagaaccatcttacaagagctcggattctgttccacataccagggcagctgcaacctggcaactatggccagggcaacactaagaaaaagacaaacacctggtcaacctagcactgccaccagctgcagtgatgccaggacccaggactcaggctcaaccccaacatagtgcatgttccctgcatagctctcattgcaaagcactcctgccattgcctggctgtccacttgacacaagtggaagcctgcacgtccaaggcagccttagcagaagcttggtgcaggcccctggaggctgtagccacagcagttgcctcctctcagcctcttgttccacaggtactactcagcaggcggtgaccttgtgaacattttgcaaacaagcaagcagcctgtggtatggacttcctggtgctgccaccacctcaaacacagactggaaagccctgcggtcgaattcctcctctatctggtgtctgtagaagtctgtggcaaccaggcagaaaaggttcacatccacctgctccagtttgcccatcctgctgatgacgtgtggaaggattgcagaaacccatgggctggtagatgcactgacaaggaagcaggagaggctccacatggccatggcaactggagttctttgtgtgaagttggacagagacagcataacccagtcccggaccatggatgactgcccagcactgtgcagagtctgaaaaaccttgtatactacagtggccatgaactgtgggtatggctgctggttggacaggaactctccaatgactttgttcatgacatcttgaggtggaaagaagtcatctagaaactgaggcaggatccttgccacgaccctggcttcacagggaaatcccttgcggatcctgtcaaagagcacagacactcgctccatagctacaatcacagactcgctgtcaggggtagcagggctggggtcagaagctctgcctggactggctttttcctttcctgtgtacatgcaggtaagcatcaggcctagggctgccatggccctgtgtgggctttgtacattcactctgtccacacttagcttgaccaaggactccgtgtctagccgagagagctgctcagacagcaggagccgttccagaccccggagggcacagtggtaaatgatggagggggtggactcctcacttccagacagcattactccacacatctgtatcacagatgctgagaattctggccccacatccagagggtagttttccatcaggtagaatgcagtggcacacatcaccagcacatgctgctggctgtgaatgttcacgcagtgggctattcctttgaggttggacagcagatagtcactaacaactggaatgagctgctttacagtgtcatccaagaggtcacactccaacacatagaggatgccatgcagggctccgatctggctgggcaggtgggtgctcctgagtgtgctctccagtaggcggctgaccggctctgccacagttttgtccattccaagaacagcagctgccttacaggtggcaggcaccaggtattgaatgaggatctcatcttctgaagggtgcactctccgtagttctgtcagcgtcagatacatcatttcaaactgggtacgttcagtgaataagtctgacaccacaagaagagatcgaaccacttcactgatcaggatgacaggggtccttctggctgcactggatggcaggatccaacggctgtataattcaagcagaaactgcgaacaggagtgaatatcaaccccagcacggtgttttctggaattgactggagacacaggtggtgatgttggcgcaggggcatccgcttcttcctcctcctcctcatcccattcctcctctctcaggggtgtgatgttgttccccagccacacggagtgtatggacacctggcccagcttgtagctcatgttgcctggctcccgctctgagttgatctgcagcagcagcttgtcatggctgataagagcacctgtagtagctggtaacagagaagggacaggatcccatgcctggtgagaatgatgagtggcagtattctctctttgggaaaccatctcttggatttcttgttctacaatccctctgatcatgctcaactttcttccaaatctggtatcgagagccttcagtggcttgttccggggctgttgctccaagcagcttacagctggattgccagccacaggcacagccattgcgctgagcactagagaggtgatggcctgtacagccaggacgtggatctgggtcctttcggtgtcttcctctggtgggctctcttcctgttccatcaccaagggctgagtcaccaggacaccaaggagggtggcccaagtttcttcgaattgagtacgactggtccaccctagggtgttgatgcggtagatgaactccttgaggacctccttctcctggaggaactctacagggatctcaggaaacactgtgccgaaatcccctccaggcttgggtgaccacccgagtttccataccagaggaggcacacgagtatagctgttaacgagggggaggcgggccagactgacaacaatgttcttcagcacagctgtgagaaatgaaggtagggtgctgttcctcttgtggcccagggccagcaccgactgcagggattccaccatgtctgccaccatctcgcaggccgaagtgatgtgactgaggttttgtatatctgagtctacttcctcctttctgacagcccttggagtatgtgacctgctttccggaccaagaagttggtctccaggttgtactgcaatggcttccaggatgaatcgcacacagtggataagggagcaagtatgagtcacgtactctggggaggacagcaccccccagaggccaggcacctgcagtgccaggcagcagcagtctaggccggcttggaggtccagactcagtgggatctgctcatggatcaaatgccatgacagggcctcaagtgtcattaccacaaacttcaccgtgtgcccctccttctcaggaggaaggtgcaaaggagcaggcactttggagagcaccaccaggtactgtgccagggcacgggcaagtgtggtcagagactggtatgatgtggtatcaccaaagagatcattcagcttgctccagtaggctgtgggttctgtaggcaggaaaggctggaagacttgatggactgcaggcagctgctgaaccacattggtcacccggtccagagtcaccctacgagccgcttcaaaaaggggactcttttggccattagcaatctcgctcatgccaaggcttaagcagggagccaaaaggcttaggttgaactccgagctcatcatgaagtcactcatatcttcagcagggatacggttcaccagctctgcaccttccagcagtgcagaatctgacctggtccaacactgggatctgacaagctggaggtaccagtctttgtccggattcactgtttccagggatgtgtgcccatccccatccagagggtgggaagtgactgggggcaaggggctaagtgagtcctgcacagtagagagtcggaatctgtccagcagtgaatagagcctttggtgtctttgtgcaagcccagtgttctggaggtgttcctggattctgttcagttcctcctctggcaactgggccatgctgctctgtaaatttgcagccaaaagcatttctactcggcgacaggccagggtgtcgaccatgcgagccagcgcacggaaaggggtgcccagtagcctgtccacatacagtgtgagcacagcaccagactggctgagatggatgccttccaagcactgaagtgttttcttcagagtggttggagttgaaagattttcacagcgagactgaattgcctggataaaaagaccactagctgcagaattacgatgaatggcactaataaagtcttgaactggaggctcgtgggacaagctgatcagatcttgaatgtgattcacaatgagccatgttaagtgttctgagtcatggagattctgacagacataatcacagaagagaataagggcccctcttcgtactatttctctattgcacattccaagctgagctgctgagccagaatcctcttcagcagatatctgggggtttagtgacttcgtgcaggacagactgtgtctcttgggcgtctgctgcacctcggcccaccatcggtggtcagtgtggttgatgagcagtaggatctgacaccagagcagtaccagagctgggtgtgtgggcaccatggctcgcacccgtgcattcaggctatctagagtatagaagctgccttcacagccatcactggtgaagagtctagtggcagcggctgtgattctccggaacattccagatttgaatatgtggatcagacacatgagcagtgtgccgagctcttggcaatagaatgtatgctgctgttcactcatgtccactttgagctgttttgtaacaatgtcttccagaagaataccaaccagctgtaagagaaaccttgagaatgtatcttctggcaaattctttacttgtttcccttcactgcgttctcctagtgttggattactgtctccatcccttaacctgttaattactggacaggaaattaaatatggagagaaggagagctcctgaatacgagaaagaacaatgtcttcggttgactgggaaatgagaaccctcagaatggctaggattccagatatccacagctgcacagtgcttacagatgccattgtgcttggagtgatgaacatactccgcaaaagcatgtccacaggacgtagggaggaaggagccaaaatctcaaacaaggtatttaatactccaagggcttcatgagagtcaatatgcatctgctgcttggctaacatgggcaggatgatgtctgcgacctgccgagagagccgtttccacttgtcctcattctctttgtggcactgctgcaggacgaggatgaacatctctagcacctgatggtactggatgagtcgtaacagcattgagaccaccacctccttctgggtttcaagctctttccctgcatcagctttatttgttcctcttaacacaaagaggtcatggacaatgggctgcagcgcaggaatagcatgtgtgacagccttccttccactggccatgatgccatcacacagctggatgattttaggaattccaatgatctgttttgaatggtagcgctcataagataatagtaccaggaagaaaaatatatttggaataattgcctctgattccctgaactggcccacttcaatgtactcaaactgcttcagcacaaacccgatgaacacctgatctgaatccagtagacagtaattgacccgtagctgaaccagctgtgccagcaaatccaaaacctgcttctgcagttgtactgatgttgtcgtggtgtactgcttcaatgcttttataacaagaggctcaaataacctaatgtggttatgaatagcgttcttatctgcacggttctttgtgacacttgtaaggttcgtcttcaactgagcagacactttctggagtacatcaaaccaccctgaggcatcgtgctcctggtccgcctgtaccatgttcctcaggctggcatcagccaaagcctgcgtgaagtgcgtgtatggtgccatgaagcagtagtgatataagccgggcctcacactggaagagccaaggcgctgtgctcggcactgagacttgctggggttggaagataagccatcaaactgtgaggctaagtttgtcccaaagagagtcttcaatagctgctgaacacagacagtcgccatcattggttctcgactaaagcaggatttcaagtatccaaggacctcttcaacacactttccaatgtcctgcagtgtcgccagctctagaatctgagaaaggacgtccaaggcagagcgcaggaaccccccaaacttttcagtgctgttctgaagatctaaggtgaccttatagttggcgtgagtggctttcaggacatcatgcagtctgaggtaggaagggagatggtagaaactcccaagtgaagatgatttactcgctgtgacaggtcctgaggtgtctgactgtcgagaggctgtactggcctctccacctttcttgggactcatcggagtggatgtttgttctccgggctctttctccttccctttccgtcgaataggacttagagaaggggggtttgtgagagaaggcaaagctgccttgattgctggtccaggagtcacgtcatccaagacatgagcacagatattgatcaccttcagcaggtgggagaaaagctgctccaccatgggcaccagagtccgatcccccagggcaggccagatctcctcctgtctggtggctgctgagctgccttcttcttccgaggcccatgagcttctcagagacttgggggcactcgctgctagcaagtttccagccaaaatcaaggcatcctgatgggctgagagatccagtgggaaccaagctgatgaaagcaaggtgagaatcatggaggccatcccaacagtgcagctcttcctggactcatcagaggcactcagtgggggcactccacagtgccatcctagactccaagtgcaaactggaaaggcggctgaaagaacacacaaggcttcacagcacccaaatgtgagtgcccgtgtagttgacgtaatgagttcatgagaaactgcggcaacgactcttgagaggttgttttccatggtgacatctgttacacttggtagtaagctgtagcctctatagattctggttatggtgctgacggagaagtgggatggtggctgggtctcatgcatgaggagcttcaggtaaacactactttgatctcttgctacagccacgactgggtcagcctgtccttggtcacacttataaaacagctttgggacaagtcttgtcaatgtcgtcgcagcaacatgtcgaaccctggggtcttcatctccaagcaaataaatgaccacattattgagtactcgttcttgtagttttagaaaccctgtataatgatgagcccctcggtgtaaactttctgcttttgcctccaaaaaactcaccagcctgaaatcaatctctgcaagagtttccagcagttcagtcctcaccagccagtaggagctgttcttcagaggcagcatgtcaataagcagttgtaatcccaagtcactgtagctgctgctgcaaagactcaggacacagtgcctcacagctgtacaagccaacttgcaagtaacagaagattcatccttcaaagttttctgcagtaaaggaatgcagtccaccagagaaaatgtatttcctgtcagggccctgatggtgcccagccagtcaccaacacggagacgggacctgctgaggatggagtagacaagggtcccacagagaatggcagtagctcctcgcacctgagggtctccatgatcgatgtagttcaggatgtcagagacatactgttcctcagtactttccatggtactgagaggtactttgtagagtttgctgaagaacgactctggatgaagggccacagctgcaccaatacagctgagggccagggccttcacactgactctcacatctctgtctggaaccagtgctttcttttcgccagttaacaaaaaggaagcggataaaagacggacacaatgtaccagaggagcagaatcatcatcattaggctgtcctatgtcacctttgattcggcaaggcttgctttctgggtccccagcttcagcaacctcatcttttgaaacaaacttatcaacactgctgtcagaaggctgccggctatgacccattctttccaacaagtgtgcctgctgaagggccagagaagagtttctgaaaacgtctgagacttcaccagaaagaacacctgcagcttcctcctcgtcttcctcctgtggctgtcctatctgcacgcctaaatactggctgtcagcaccatctaagacaatttcagaactgtcagaaggagtcacagctgaatcaggtccttcagtggtggtctgagaactgtcactgatgggtgaggaggcctgggtcccatcattcaggtccatggcagggtcggatggaacagcactgaactggctggagctgtggctcaagatgtcttcctcatctccatcagtagcagcactggtcaagtcacagcctgacaaatccacagagtctgcttgaagtgtgtgctgggatcgaggctgctcagtgatgatgtcgtgacctacagaaccgggagtggagacacccgaagaagaagcagcgagctctccaccaatctcactcttcacagaggctgcaaaggctgagctgctgacatctgacctggactccgagtcatcctccaaggcttcttcctctcctaagagcactttgcctttttgctttcttgagagaacagggctgcatgaggaaccccctccagctaaaagctccacgatactcccgctgcggcctcggcccccggcttcctctcgaaccagagtgagctgcccgagccctcctggtgtggtcagtgcttgcagcagctcaggtggaggggtacggaagagctgctgcaggagctccaatgcccctgtcaccacattatggtcttggtgctgtgtgtgatgcaaagtcagttcataaacctggacaagctgctctgcagaaggagagacttccatttctttccgtgttaccccaaagctgccctttagacttgtgtccttgacctgctgctggagcaagggcactagacacctcagtgtgagcaacacaccaaggatcaggagagtggggtggtcttcctccatgggaaccagcaaacctaggagcacattcaggagccagttgtagaagtactgtgtcctcctagagtgctggcagatactcactgctgacccagctgctgtccgccgcacagtgggagagcttgacttcagatttgctatgaaagctttcaatagaaccttaatttcattgtcattcgcgaaattgccaaaagaggccataattttaggaacagctgcagccaaagtctcctgaactgactcctccggtcgtttgcttgttcgggtcaaacatggaagaagattcaccagataaggcctgcacttctgaggtcgaaccaggtgagccagctcagcaaacctccacagagctgcacgcaaacttcgaggagcaccattctttttaatttccttatagagttctaactgtagccttggaagattagagtccatcaaagctttgatgactttgttgaggcactcatcagccaccattctgacgtctgactccgcatcgtcgctgcacagcagaaacagttccatagcaatgcccaagagtttctgaaattctggagaatttctgagagactgtgccacaatgttttcacatattgttagacagtgattcacacggtccttcttggtggctgagagttccttctttggtcggtgcagcggctcctcggccggacctggcagcggcggtggtggcggcggctgcccctgaggcggcggctgagggggttgaggcggcggcggcggcggtggtggcggcgcctgcggcggcggctgctgctgctgctgttgctgctggaacgacttgagcgactcgaaagccttcatcagtttttccagggttgccatgacggcctcctgcccgacaggacagaccctgaaggcttggagcctattcgcactacgcagcgccacttagcagcaaggtaatgaatggggctctacgaggtagaccgaagcggaaccaaagctcccagccatcttgggcccgtcccggcaaccctcgcggcgagtgc

SEQ ID NO: 9 - DNA, 13328 bp, Macaca fascicularis
tgatggtttcaatgtttttcctttaatttggatgtacaatgtttgcagcagttaaaaaaattaaatatacatctctcgtcagtccttccctttgctctcagaagcagtcaggtctgggtggggctccgggactcacccatcacagccctgctggctccaggggagctcaggctcagctgacagtccctctgaccacagcgcaaagcaatgagacctggacaaggaggccccacgtgggtcagagcccaccctccgtaggcaggtccacgttggccacaatcctccaaggctggcaatcaccacccagattgcagcgggagactctgcttttggaaacaactgaggggaaggcgttccttggactgcaccagagcgtgacaggcacacgggggaagagtggcctctgaaccttccaggttgccttcagttgtcatgcggcgctctgagcggctccctccttcccaggaggcccaggcctggcgagcgagtgtcctcttctcgcctggaccatcctgagctctccagggtgcctcggcagctctcaagatcttccttcttctcgctccctcaggtggcccctccggagcacagctccaagcctaccctggccagcagctgtggtcctgggtcctccccgcagagggaggaagtggggagggacaaagccgggtgaggatgtctgctgggcaggatgctcacaggtagcaggagcaggctgactccaccccacagacacacagaactaacctcactccgcccctcagggggaggaacttccacctgccaggcagccacagaccgagttattgctgtttactatccgtcccgagctccgtggggggctcagctcagctccaagaggacgagctgttcatcggctccgagggctctggaatgacccctccatgaaggtgggggcgggggtgtcctttagggcacagggccttctcagatgctacattctgggtgtctggaggggtttcagcttcacattttcctcctgaaaggacacgtgtgctggcagaaatgggggtggacagtaacaaagagcgcttggcagccggaaacgtcacctacacagactcagctgggcccgcagcggaagggaggcacgttttgggaaagaaacgcgcttcagtgcattgccaaacaattctaccctggtttcattaaagtctttcctgatattaccagcagcaaaacaaaagcagtctccccacagctcacccccaaaacttgacaaccaaattaatcacattttcaacaaaatttggataatatgattggtgcttgccataggttttttaggaacgcgacaaagtcttcctcccttcggcagagttgatatggagaccgttttctccggtgggatcctagtgagccatgaatgagccctgctctgaccaagccccgcgcctggacgcccgtcacacagctaactttacctggcaggtctgaggaaagtcaacttccaggaagaaccgacacgggcactcttggaggccatgcatctctgtcttgagatgtgcgtgtataaaactacagatgtgtccatatgcacgtgcacgtgtacttgacttacgcatgggtaaagtcattttactaatgagctcatattcatctctggagcacacaggcaggcctttgggagtgggggacacccactgccagagcggggtgttctgagccccttgctaaggactgttttagatcacgtcgtaaacaaaaggaagacaaactctgtgttgagcccagcgatatgcattccaaggggaatggctccgttttacattcacagtgttatttcttacaaatgtaaacatctagcagaacaacatctggcctgtgatacttctgtctccgagctgttgacataacttactgcaggggaggtgggtggggagcagcaacggttctgagaactttcccctcattcccaaagcttctagcaggctttccaggaagaagctaggatgagaaacaggagcccccaaccaatacggaagaacggtggttttcttgttaaaattcagtagcttcccttaagggcctcctcaaacatcagacccctttctaccgctcctgctgccctgccacgaggacgaggtggtcctggctgggggaggcctctgttgggagctggtgggaaaagcctcatacaggcctgtcaaaggctgctcagaggaggggctccctttgagcaggggctccctttcagcgccccctcatgtatgtgggcagcacacaagtccacatgtcagctgctcctcagctgccacataggagagggacaggtggaagcttgagggtctcaaggcagcacctgcacagactccagaaaagcatttcctccacttaccatattcaatacccaaaacatcaacaggcatgagcaaaccaagccacatgacagtcgccaacctcgcctggctcgcctcaagggctgaggaagcagagctcctgccccatctcagagctcccaaatccagctcctatgtcagcagcagccggccatccagaatccacttccattttaatgacttggctcctctgggcctgcaaacaagaggctggtccagggacctggcctggggataggagtggcggctctgacagggcagtggggcagtctccaatgagcacagatctgcactctcctgactaaaaggggtccccgtgcaagatgtcagctggaacgggggcagaagggatgccaggctctgtcactaacagtgccaagacgccaagctttgctgttgaccaagagaggctcagacaaaacacagctcagtgacacccttggggcatgcatccatggaacggcagatcccaacaccggccagccagctcctgggcagacaccgccccagggctagcaaggaacaggagtgggaggcccatgtctctggacacagcggaggctgctcacagccagggagggctggccttctcagctgatagggaggctgctgtccctaatgtgggtggagaacaacagttgtctgtgcccaagaaggaggggctgcaggcgagcatgcccctaggacagtgggggcctgtccttagtcctgctgtggccacctgcacactagcgcctctctacatcccagtcaccttgtgaatgcataaacaggaacatgtacaacggaaatgtcagcgggtgctcaggaaggctatgccagtggctacaggagagggagcgtggccaggggccctgcccacctccccgaacactgtcgcatgcagcacaggccttgcaattcacatactttacacgggcatagaaagagttacgttaaaattaatctctttactgatataattaaattttaaatcctgagaagaaaagagagaagggagaatggtgctgggtgtctagcacccccagccactggcccagcacatgccatggcatctgtgcatacagacacagggcgtggcatgcacaccccaccaggaagacacaggccagtgttcccaaagcctgctcacggcaccttctactgcaggacagcagaggggcccacagccagcctgcaggagggaggacttccggcccagatgcaagagcagctgcagcctggcaacacccaacaggtgagcatcaggagaaaggacctggtcacccacatggcgtgcagcacagctgctcctgctctccggaaggcctcaggctcagccccaccgggactgcagatactccttgcctggccactgtaccacaaagagcacttctgccatatggcagagacacgcacgttgcctggccgcccgcggcatgtgcggaagcccacagggaccaagctggctcggtggaggcagggcacagggcgcagatttctggaggctccagccccagctgccgcctcacagtctctcccaccatggcgctcagcaggtggtgaccttgtggacatttcgtaaacaagtcagcagccggtgatatgggcttcctggagctgcaaccacctcaaacacagactggaaggccctgcggtcgagctcctcctctatctggtgtctgtaaaagtctgtggcaaccaggcagaaaaggttgacgtccacctgctccagctttcccatcctgctgatgacatgtgggaggatcgccgcaacccatgggctggtggacgcgctgacgaagaagcaggagaggctccatgtggccatggcgactggggtcctctgcgtgaagttggagagggacagcatgacccagtcccggaccatggatgactgcccggtgctgtgcagagtctgaaacaccttatacaccaccgtggccatgaactgggggtatggctgctggttggacagaaactctccgatgactttgttcatgatgtcctggggtgggaagaagtcatctagaaactggggcaggatcctcgccaccactctggcttcacaaggaaagcctttcctgatcctatcaaaaagaacagacacccgctccatagcaacaatcaccgactcgctgtctggggctgcaggattagggtctgaagttctacccggactgactttctcctttcctgtgtacatgcaggtgagcatcaagcccagagccgccatggcccggtgcgggctgtgcacgttcactctgtccacactcagcttgaccagggattctgcatccaggcgggagagctgctcagagagcaggaggcgctccaggcctctgagggcacagtggtaaatgatagagggggtggactcctcacttccggacagcatcaccccacacatctgtattattgatgctgaaaattctggccctacgtccagaggatagttctcaatcaggtaaaacgcagtggcacacatgaccagtacgtgctgctggctgtgaatgttcacgcagtgggcgatccctttcaggttggagaggagatagtcactgatgactgggatgagctgcttggcagtatcgtccagcaggtcgcactccagcacatagaggatgccgtgcagggctccgaccctgctgggcaggtggctgctcctgagtgtgctctccagcaggcggctgacaggctccgccacgaccttgtccatcccaaggacggcagctgccttgcaggtggcgggcaccaggtactgagcgaggatctcgtcttctgaaggatgcacccttcgcagttctgtcagcgtcacatacatcagctcaaactggttgcgctcagtgaacaagtctgagaccaccagaagggatcgaaccacctcactgatcaggatggccggggtcctcctggctgagttggatggcaggatccagcggctgtacaactcgagtaaaaactgcgaacaggaatggatgtcaactccagcccggtgtttcctggagttgactggagacgtgggtggtgatgaaggtgcaggggcgtcggcctcctcctcctcctcctcgtcccattcctcctcccttaggggtgtgatgctgttccccagccacacagagtgtatggacacctggccgagtttgtagctcacgctccccagctcccgctcggggttgatctgcagcagcagcttctcgtggctgatgagggcacctgtggtagccggggacagagaagggacaggatcccacgcctggtataaatgatgggtggcgatgttctctctctttgaaaccattgcttgaatctcttgctctacaatccctctgataatgctcagcttcctcccaaacctggtgtccagagctttcagaggcttgttccgaggctgctgctccaagcagctcacagctgggttgccggccacaggcacggtcattgcactgagcaccagtgaggtgatggcctgcacggccaggacgttgatctgcgtcctctctgtgtcttcttctggtgggctctcctcctgctccatcacgaggggctgcgtcaccaggacaccaaggagagtggcccaagtttcttcaaactgagtacgactggtccagcctagcgtgttgatgcggtagatgaactccttaaagacttccttttcctggaggaactccacggggatctcagggaatgctgtgccaaaatcccctcccggtttgggtgaccatccaagcttccacaccagtgggggcacacgtgtgtagctgttgacaaggggcaggcgggccaggctgacgacgatgttcctgagcactgacgtgagaaacgccggcacgccactattccttttatgacccaaagccaacaccgactgcagagactccaccatttctgccaccatctcacaggctgcggtgatatacttcggattctgtgtgttaggatctatttcctcctcctcctctctgatggcttttggggtatttgtccttctttctggactaagaagctgctctccaggctgcactgcaacggcctccaggatgaagtgcacacagtggatgagggagcaggcgtgggtcacaaactctgcggaggagaccacgctccagaggccaggcagctgcagggccaggcagcagcagtccagccctgcctggagatccagactcagcggaatctgctcatggatcaaatgccaggacagggcctcaagggttgccaccacgaatttcatggtgtccttctctttctcaggaggaaggtgcaagtgactgggcagtttggagaccgccaccaggtactgtgccagggcccgggccagagtggtcagggactgatacagcgcagcatccccaaatagatcattcaacttgctccagtaggccgccggctctgcaggcaggtcggactggaagacgtggtggacagcagggagctgctgcacggtgctgctcacgcgggccagagtcacctcacgggctgcttcaaaaagcggactcctctggccaccagaaatttcactcatccctaggcttaagcatggagctagcaggcttaggttgaactccgagttcatcatgaaggcactcatatcttcagcaggaatccgattcaccagctctgcaccttccagcagcgcagaatctgacctggtccaacactgggatttgacaagatgaatgtaccagtctttgtccggactcactgtttccagtgacacgtgcccgtccccgtccagcgggtgggaagagactgggggagagggactaagtgagtcttgcatggtggagagacgaaacctgtccagcagggaatagagcctctggtgtctctgagcgagcccgctgctctgaaggtattcctggattctgttgagttcttccattggcaactgggccatgctgctctgtaaatttgcagccagaagcatttctacccggcgacaagcaaggatgtcgaccatgcgagccagcacacggaaaggggtgcacagcagcctgtccacatacaacgtgagcacagctcccgactggctgagatggatcccctccaagcactgaagagttttcttcagagtggttggagttgaaaggttttcacaacgagactgaattgcctggatgaagaggccgctggcagcggagttccgatgaacagcactgatgaagtcctgtactggaggctcgtgggaaaggctgatcagatcttgaatgtgatttacaatgagccacgttaagtgctcggagtcatggaggttctgacagacataatcacagaagagaatgagagcccctcttcgtactatttctctattgcacattccaagtttggctgccaagtcagaatcctcctcttctccagacatctggggactaagtaactttgtgctggacagactgtgtcttttcggggtctgctgcacttctgcccaccagcggtagtcggtgtggttgacaagcagcaggatctgacaccagagcagcaccagggccgggtgggtggtgatcatggaacgagcccgcaaattcaagctgtccagggtgtagaaactgccgccacagccatcactgcggaacagtctagtggcagctgctgtgattctccggaacattccagacttgaagatgtggatcagacacattagcagagtgcctagttcttggcaatagaaagtatgttgctgctcactcatttccaccttcagctgttttgtaacaatgtcttctaaaagaatacccaccagttgtaatagaaaccttgaaaatgtttcttccggcaaattctttatttgtttcccttcactgtgttcttctagtgctgaattactgtccccatctcttagcctattaattactggacaggagattaaatatggagagaaagagagctcctgaatacgagaaagaacaatatcttcagttgactgggaaatcagaaccctcaaaatggccagaattcctgatatccacagttgaacagtgctcacagatgccattgtgtttggagtgacgaacatactccgtaaaagcatgtccaccggacggagggaggaaggggccaaaatctcaaataatgtatttaacactccaagggcttcatgagagtcaatgtgcatctgctgtttggctaacattgggaggatgatgtcagctatctgtcgagacagtcgcttccacttgtcttcattctccttgtggcactgctgcaggacgagaatgaacatctccaacacctgatggtactggatgagtctcagtaacattgataccaccacttctttttgggtttcaagctcttttcctgcatcagctttatttgttcctcttaatacaaaaaggtcatggactatgggctgcagagccggtatggcgtgtgtcacagccttccttccactggccatgatgccatcacagagctgaatgattttaggaattccaatgatctgttttgaatgatagcgttcataagacagtaataccaagaagaaaaagatgtttggaatgattgcctctgattccctgaactggcccacttcaatgtattcgaactgtttcaatacaaagccaataaacacctgatctgaatccagaagacagtaattaacccgtaactgaaccagctgcgccagcaaatctaaaacctgcttctgtaactgcacagatgttgttgtcgtgtactgttttaaagcttttataacaagaggttcaaacaaacgaatgtgattatgaatagcattcttatctgcacggttctttgtgacacttgtgaggttcgtcttcaactgggtagacactttctggaggacatcaaaccatcccgaggtgtcgtgctcctgctccgcctgcaccatgttcctcaagctggcgtcagcgagggcctgggtgaagtgggtgtacggggccatgaagcagtagtggtacaagcctggcctcacactggaggagccaaggcgctgtgctcggccttgtgacttgctggggttggatgataagccgtcaaactgggaggccaagtttgtcccaaagagagtcttcaacaattgttgaacacaaacagttgccatcattggttctcgactaaagcaggatttcaggtatcctaggatctcctcaacacacttcccaatgtcctgcagtgtggccagctctagaatctgagagagaacgtccaaggctgagcgaagaaaccctccaaatttttccgtgctgttctgaagatccaaggtgaccttgtagttagcgtgcgtagctttcaggacatcatgcagtttgaggtatgaaggaagatgatagaaactccccagtgatgaggatttacttgttgtaacaggacctgaggtatcagattgtctagaagctgcactggcctcactgcctttcttgggactcaacggtacagatgcttgttctcctggttctttctccttcccctttcgtcggatgggacttagagaaggggggtttgttagagaaggcaaggctgcctttattgccggtccaggagccacgtcgtccaggacatgtgcacaaatgttgatcaccttcagcaggtgggagaagagctgctccaccatgggcaccaaggcccggtcccctagggctggccagacctcctcttgcttggtggctgctgggttggcttcttcttcagaggcccatgaacttctcagagatttaggagcactggctgcaagcaagtttccggccaaaatcaaagcatcttgatgggctgagagatccaatgggaaccaagctgacgagagcagggtcagaatcatcgtggccatcccaacggtacagctcttcctagactcatcggaggcgctcagtggaggcactccacagtgccaacctaaactccaaatgcaaactgggaaggcagtggaaagaagacacaaagcttcacagcatccaaaagtgagtgctctcgtggttgatgtgatcagttcatgagaaactgctgcaataactcttgaaaggttattttccatagtgacatctgttatgcttggtagtaggttatagcctctgtatattctggttattgtgctgacggagaaatgagatggaggctgcgtctcatgcatgagaagtttcaggtaaacactgctttgatctcttgccacggccactactgggtcagcttgtccttggtcacatttataaaacagctttgggacaagcctaattaatgatgctgcagcaacatgtcgcaccctggggtcttcatccccaagcaaatggatgacaacattattgagcactcgttcttgcagctttaaaagccctgtataatgatgagcccctctgtgtaagttttctgcttttgcctccaaaaagctcaccagcctgaagtcaatctccgcaagggtttccagaagctctgtcctcaccagccaataggaactgttcctcagagtcagcacgtcgatgatcagctgcagtcctaactcactgtagctgctgctgcagagactcatgacacaatgcctcacagctgtacaagccagcttgcaagtgacagaagactcgtccttcagtgttttccgcagcaaaggaatgcaatccgccaaagaaaatgtgtttcctgtcagggttctaatggcgcccatccaatctcccacgtggaagcgggacctgctgaggatggagcagatgagggtcccacagagaatggcagtggctcctcgaacctgtgggtctccatgatcgatgtagttcaagatatctgagacatattgttcctcagggtattctgtggtgtcaagaggaactttatagagtttgctgaagaaagattctgggtggagagccacagctgctcccacacagctgagggccagggccttcacgctgaccctcacatcccggtccggaaccagcacattttttccccctgttagcaaaaacgaagcagataaaaggcggacacaatggacaagaggtgcagaatcatcatcagtggactgtccgatgtcacctttgatgcggcaaggcttgttttcttgatcacccggttcagtagcttcatctctcaacacaaatttatcaacactgctgtcagaaggctgcctgctgtgactcatgtttttcaataaatgtgcttgttgaagggccatggaagagttcctgaaggcctccgaggcttcgtcaggaagaacacctgtggcttcctcatcttcatcctggggctgtccaatctgcaggcccaaatactggttgtcggtaccgtctaacacaatttcagaactgtctgaaggggtgacagctgaatcaggcccttcggtggtggtctgggagctgtcgctgatgggcgaggaggcctgggtcccatcattcaggtccatggcagggtcagatgggacggcgctgacctggctggagctgtggctcaagatatcctcctcatccccatccgtggcagagcttgtcaagtcacagctggccagatccactgagtccgcctgcagcgtgtgctgtgaccgtggctgctccgtgatgatgtcgtgacctgctgaccctggagtggaaacccctgaagaagtagccagctctccactgatatcatccttcactgaggctgcaaaggcagagctgctgacatccgatctcgattcagagtcatcctccaaggcttcttcttctcctaagagcactttgcctttttgttttcttgaaaggacagggctgcatgaggaaccccctccagctataagttccacaatactcccactacggcttcggccaccagactcctccttagcggcggtgagctgcccaatgccccccactgtggtcagggcttgcagaagctcggggggaggcgttctgaagagctgctgcaacagctccagggctccggtcacaacattgtggtcttggtgctgtgtatgatgtaacgtcagttcataaacctggacaagctgctccgcagaaggacagacctccatttctttccgtgtcactccgaagctgcctttcaggcttgtatccttgacctgctgctgcagcaagggcaccaaatacctcagggtgagcagcacgccaagaatcagcagggtggagtgctcctcctcgacaggaaccagtaagcctaagagcacatttagtagccagctatagaaatactgtgtccttcttgagtgctggcagatgctcactgctgatccagcagctgtccgccgaatggtgggggagcttgacttcaggttcgctatgaaggcctttaacaaaaccttaatttcattgtcatttgcaaaattgccgaaagaagccataattttgggaacagctgcagccaaggtctcctggactgattcctcgggtctcttgcttgttcgacttaggcacggcagaaggttcaccaggtaaggcctgcatttctgaggccgaaccaggtgagccagctcggcaaacctccacagggcagcacgcaaactccgaggggcaccattctttttaatttctttatagagctcgagctgtaaccttggaagattagaatccatcaaagctttgataactttgttgaggcattcatcagccaccattctgacatccgactctgcgtcatcactgcacagcagaaaaagttccatagcgatgcccagaagtttctgaaattctggagaatttctgacagactgtgccactatgttttcacatattgtcagacaatgattcacacggtctttcttggtagctgaaagttctttctttggtcggtgcagcggctcctcagccacagccgggccgggtggctgctgctgctgctgctgctggaaggacttgagagactcgaaggccttcatcagcttttccagggtcgccatggcggtctcccgcccggctgggcagtccccggaggcctcgggccgactcgcagcgccgctcagcaccggggcaatgaatggggctctgggccgcgggtaaaagcggaaccgaagcggccgtccatcttggacccgtcccggcagcccccgcggcgcct

SEQ ID NO: 10 - DNA, 13447 bp, Macaca mulatta
tggtttcaatgtttttcctttaatttggatgtacaatgtttgcagcagttaaaaaaattaaatatacatctctcgtcagtccttccctttgctctcagaagcagtcaggtctgggtggggctccgggactcgcccatcacagccctgctggctccaggggagctcaggctcagctgacagtccctctgaccacagcgcaaagcaatgagacctggacaaggaggccccacgtgggtcagagcccaccctccgtaggcaggtccacgttggccacaatcctccaaggctggcaatcaccacccagattgcagcgggagactctgcttttggaaacaactgagggaaggcgttccttggactgcaccagagcgtgacaggcacacgggggaagagtggcctctgaaccttccaggttgccttcagttgtcatgcagcgctctgagcggctccctccttcccaggaggcccaggcctggcgagcgagtgtcctcttctcgcctggaccatcctgagctctccagggtgcctcggcagctctcaagatcttccttcttctcgctccctcaggtggcccctccggagcacagctccaagcctaccctggccagcagctgtggtcctgggtcctccccgcagagggaggaagtggggagggacaaagccgggtgaggatgtctgctgggcaggatgctcacaggtagcaggagcaggctgactccaccccacagacacacagaactaacctcactccgcccctcagggggaggaacttccacctgccaggcagccacagaccgagttattgctgtttactatccgtcccgagctccgtggggggctcagctcagctccaagaggacgagctgttcatcggctccgagggctctggaatgacccctccatgaaggtgggggcgggggtgtcctttagggcacagggccttctcagatgctacattctgggtgtctggaggggtttccgcttcacattttcctcctgaaaggacacgtgtgctggcagaaatgggggtggacagtaacaaagagcgcttggcagccggaaacgtcacctacacagactcagctgggcccgcagcggaagggaggcacgttttgggacagaaacgcgcttcagtgcattgccaaacaattctaccctggtttcattaaagtctttcctgatattaccagcagcaaaacaaaagcagtctccccgcagctcacccccaaaacttgacaaccaaattaatcacattttcaacacaatttggataatatgattggtgcttgccataggttttttaggaacgcgacaaagtcttcctcccttcggcagagttgatatggagaccgttttctccggtgggatcctagtgagccatgaatgagccctgctctgaccaagccccgcgcctggacgcccgtcacacagctaactttacctggcaggtctgaggaaagtcaacttccaggaagaaccgacacgggcactcttggaggccatgcatctctgtcttgagatgtgcgtgtataaaactacagatgtgtccatatgcacgtgcacgtgtacttgacttacgcatgggtaaagtcattttactaatgagctcatattcatctctggagcacacaggcaggcctttgggagtgggggacacccactgccagagcggggtgttctgagccccttgctaaggactgttttagatcacgtcgtaaacaaaaggaagacaaactctgtgttgagcccagcgatatgcattccaaggggaatggctccgttttacattcacagtgttatttcttacaaatgtaaacatctagcagaacaacatctggcctgtgatacttctgtctccgagctgttgacataacttactgcaggggaggtgggtggggagcagcaacggttctgagaactttcccctcattcccaaagcttctagcaggctttccaggaagaagctaggatgagaaacaggagcccccaaccaatacggaagaatggtggctttcttgttaaaattcagtagcttcccttaagggcctcctcaaacatcagacccctttctaccgctcctgctgccctgccacgaggacgaggtggtcctggctgggggaggcctctgttgggagctggtgggaaaagcctcatacaggcctgtcaaaggctgctcagaggaggggctccctttgagcaggggctccctttcagcgccccctcatgtatgtgggcagcacacaagtccacatgtcagctgctcctcagctgccacataggagagggacaggtggaagcttgagggtctcaaggcagcacctgcacagactccagaaaagcatttcctccacttaccatattcaatacccaaaacatcaacaggcatgagcaaaccaagccacatgacagtcgccaacctcgcctggctcgcctcaagggctgaggaagcagagctcctgccccatctcagagctcccaaatccagctcctatgtcagcagcagccggccatccagaatccacttccattttaatgacttggctcctctgggcctgcaaacaagaggctggtccagggacctggcctggggataggagtggcggctctgacagggcagtggggcagtctccaatgagcacagatctgcactctcctgactaaaaggggtccccgtgcaagatgtcagctggaacgggggcagaagggatgccaggctctgtcactaacagtgccaagacgccaagctttgctgttgaccaagagaggctcagacaaaacacagctcagtgacacccttggggcatgcatccatggaacggcagatcccatcaccggccagccagctcctgggcagacaccgccccagggctagcaaggaacaggagtgggaggcccatgtctctggacacagcggaggctgctcacagccagggagggctggccttctcagctgatagggaggctgctgtccctaatgtgggtggagaacaacagttgtctgtgcccaagaaggaggggctgcaggcgagcatgcccctaggacagtgggggcctgtccttagtcctgctgtggccacctgcacactagcgcctctctacatcccagtcaccttgtgaatgcataaacaggaacatgtacaacggaaatgtcagcgggtgctcaggaaggctatgccagtggctacaggagagggagcgtggccaggggccctgcccacctccccgaacactgtcgcatgcagcacaggccttgcaattcacatactttacacgggcatagaaagagttacgttaaaattaatctctttactgatataattaaattttaaatcctgagaagaaaagagagaagggagaatggtgctgggtgtctagcacccccagccactggcccagcacatgccatggcatctgtgcatacagacacagggcgtggcatgcacaccccaccaggaagacacaggccagtgttcccaaagcctgctcacggcaccttctactgcaggacagcagaggggcccacagccagcctgcaggagggaggacttccggcccagatgcaagagcagctgcagcctggcaacacccaacaggtgagcatcaggagaaaggacctggtcacccacatggcgtgcagcacagctgctcctgctctccggaaggcctcaggctcagccccaccgggactgcagatactccttgcctggccactgtaccacaaagagcacttctgccatatggcagagacacgcacgttgcctggccgcccgcggcatgtgcggaagcccacagggaccaagctggctcggtggaggcagggcacagggcgcagatttctggaggctccagccccagctgccgcctcacagtctctcccaccatggcgctcagcaggtggtgaccttgtggacatttcgtaaacaagtcagcagccggtgatatgggcttcctggagctgcaaccacctcaaacacagactggaaggccctgcggtcgagctcctcctctatctggtgtctgtaaaagtctgtggcaaccaggcagaaaaggttgacgtccacctgctccagctttcccatcctgctgatgacatgtgggaggatcgccgcaacccatgggctggtggacgcgctgacgaagaagcaggagaggctccatgtggccatggcgactggggtcctctgtgtgaagttggagagggacagcatgacccagtcccggaccatggatgactgcccggtgctgtgcagagtctgaaacaccttatacaccacggtggccatgaactgggggtatggctgctggttggacagaaactctccgatgactttgttcatgatgtcctggggtgggaagaagtcgtctagaaactggggcaggatcctcgccaccactctggcttcacaaggaaagcctttcctgatcctatcaaaaagaacagacacccgctccatagcaacaatcaccgactcgctgtctggggctgcaggattagggtctgaagttctacccggactgactttctcctttcctgtgtacatgcaggtgagcatcaagcccagagccgccatggcccggtgcgggctgtgcacgttcactctgtccacactcagcttgaccagggattctgcatccaggcgggagagctgctcagagagcaggaggcgctccaggcctctgagggcacagtggtaaatgatagagggggtggactcctcacttccggacagcatcaccccacacatctgtattattgatgctgaaaattctggccctacgtccagaggatagttctcaatcaggtaaaacgcagtggcacacatgaccagtacgtgctgctggctgtgaatgttcacgcagtgggcgatccctttcaggttggagaggagatagtcactgatgactgggatgagctgcttggcagtatcgtccagcaggtcgcactccagcacatagaggatgccgtgcagggctccgaccctgctgggcaggtggctgctcctgagtgtgctctccagcaggcggctgacaggctccgccacgaccttgtccatcccaaggacggcagctgccttgcaggtggcgggcaccaggtactgagcgaggatctcgtcttctgaaggatgcacccttcgcagttctgtcagcgtcacatacatcagctcaaactggttgcgctcagtgaacaagtctgagaccaccagaagggatcgaaccacctcactgatcaggatggccggggtcctcctggctgagttggatggcaggatccagcggctgtacaactcgagtaaaaactgcgaacaggaatggatgtcaactccagcccggtgtttcctggagttgactggagacgtgggtggtgatgaaggtgcaggggcgtcggcctcctcctcctcctcctcgtcccattcctcctcccttaggggtgtgatgctgttccccagccacacagagtgtatggacacctggccgagtttgtagctcacgctccccagctcccgctcggggttgatctgcagcagcagcttctcgtggctgatgagggcacctgtggtagccggggacagagaagggacaggatcccacgcctggtataaatgatgggtggcgatgttctctctctttgaaaccattgcttgaatctcttgctctacaatccctctgataatgctcagcttcctcccaaacctggtgtccagagctttcagaggcttgttccgaggctgctgctccaagcagctcacagctgggttgccggccacaggcacggtcattgcactgagcaccagtgaggtgatggcctgcacggccaggacgttgatctgcgtcctctctgtgtcttcttctggtgggctctcctcctgctccatcacgaggggctgcgtcaccaggacaccaaggagagtggcccaagtttcttcaaactgagtacgactggtccagcctagcgtgttgatgcggtagatgaactccttaaagacttccttttcctggaggaactccacggggatctcagggaatgctgtgccaaaatcccctcccggtttgggtgaccatccaagcttccacaccagtgggggcacacgtgtgtagctgttgacaaggggcaggcgggccaggctgacgacgatgttcctgagcactgacgtgagaaacgccggcacgccactattccttttatgacccaaagccaacaccgactgcagagactccaccatttctgccaccatctcacaggctgcggtgatatacttcggattctgtgtgttaggatctatttcctcctcctcctctctgatgacttttggggtatttgtccttctttctggactaagaagctgctctccaggctgcactgcaacggcctccaggatgaagtgcacacagtggatgagggagcaggcgtgggtcacaaactctgcggaggagaccacgctccagaggccaggcagctgcagggccaggcagcagcagtccagccctgcctggagatccagactcagcggaatctgctcatggatcaaatgccaggacagggcctcaagggttgccaccacgaatttcatggtgtccttctctttctcaggaggaaggtgcaagtgactgggcagtttggagaccgccaccaggtactgtgccagggcccgggccagagtggtcagggactgatacagcgcagcatccccaaatagatcattcaacttgctccagtaggccgccggctctgcaggcaggtcggactggaagacgtggtggacagcagggagctgctgcacggtgctgctcacgcgggccagagtcacctcacaggctgcttcaaaaagcggactcttctggccaccagaaatttcactcatccctaggcttaagcatggagctagcaggcttaggttgaactccgagttcatcatgaaggcactcatatcttcagcaggaatccgattcaccagctctgcaccttccagcagtgcagaatctgacctggtccaacactgggatttgacaagatgaatgtaccagtctttgtccggactcactgtttccagtgacacgtgcccatccccgtccagcgggtgggaagagactgggggagagggactaagtgagtcttgcatggtggagagacgaaacctgtccagcagggaatagagcctctggtgtctctgagcgagcccgctgctctgaaggtattcctggattctgttgagttcttccattggcaactgggccatgctgctctgtaaatttgcagccagaagcatttctacccggcgacaagcaaggatgtcgaccatgcgagccagcacacggaaaggggtgcacagcagcctgtccacatacaacgtgagcacagctcccgactggctgagatggatcccctccaagcactgaagagttttcttcagagtggttggagttgaaaggttttcacaacgagactgaattgcctggatgaagaggccgctggcagcggagttccgatgaacagcactgatgaagtcctgtactggaggctcgtgggaaaggctgatcagatcttgaatgtgatttacaatgagccacgttaagtgctcggagtcatggaggttctgacagacataatcacagaagagaatgagagcccctcttcgtactatttctctattgcacactccaagtttggctgccaagtcagaatcctcctcttctccagacatctggggactaagtaactttgtgctggacagactgtgtcttttcggggtctgctgcacttctgcccaccagcggtagtcggtgtggttgacaagcagcaggatctgacaccagagcagcaccagggccgggtgggtggtgatcatggaacgagcccgcaaattcaagctgtccagggtgtagaaactgccgccacagccatcactgcggaacagtctagtggcagctgctgtgattctccggaacattccagacttgaagatgtggatcagacacattagcagagtgcctagttcttggcaatagaaagtatgttgctgctcactcatttccaccttcagctgttttgtaacaatgtcttctaaaagaatacccaccagttgtaatagaaaccttgaaaatgtttcttctggcaaattctttatttgtttcccttcactgtgttcttctagtgctgaattactgtccccatctcttagcctattaattactggacaggagattaaatatggagagaaagagagctcctgaatacgagaaagaacaatatcttcagttgactgggaaatcagaaccctcaaaatggccagaattcctgatatccacagttgaacagtgctcacagatgccattgtgtttggagtgacgaacatactccgtaaaagcatgtccaccggacggagggaggaaggggccaaaatctcaaataatgtatttaacactccaagggcttcatgagagtcaatgtgcatctgctgtttggctaacattgggaggatgatgtcagctatctgtcgagacagtcgcttccacttgtcttcattctccttgtggcactgctgcaggacgagaatgaacatctccaacacctgatggtactggatgagtctcagtaacattgataccaccacttctttttgggtttcaagctcttttcctgcatcagctttatttgttcctcttaatacaaaaaggtcatggactatgggctgcagagccggtatggcgtgtgtcacagccttccttccactggccatgatgccatcacagagctgaatgattttaggaattccaatgatctgttttgaatgatagcgttcataagacagtaataccaagaagaaaaagatgtttggaatgattgcctctgattccctgaactggcccacttcaatgtattcgaactgtttcaatacaaagccaataaacacctgatctgaatccagaagacagtaattaacccgtaactgaaccagctgcgccagcaaatctaaaacctgcttctgtaactgcacagatgttgttgtcgtgtactgttttaaagcttttataacaagaggttcaaacaaacgaatgtgattatgaatagcattcttatctgcacggttctttgtgacacttgtgaggttcgtcttcaactgggtagacactttctggaggacatcaaaccatcccgaggtgtcgtgctcctgctccgcctgcaccatgttcctcaggctggcgtcagcgagggcctgggtgaagtgggtgtacggggccatgaagcagtagtggtacaagcctggcctcacactggaggagccaaggcgctgtgctcggccttgtgacttgctggggttggatgataagccgtcaaactgggaggccaagtttgtcccaaagagagtcttcaacaattgttgaacacaaacagttgccatcattggttctcgactaaagcaggatttcaggtatcctaggatctcctcaacacacttcccaatgtcctgcagtgtggccagctctagaatctgagagagaacgtccaaggctgagcgaagaaaccctccaaatttttccgtgctgttctgaagatccaaggtgaccttgtagttagcgtgcgtagctttcaggacatcatgcagtttgaggtatgaaggaagatgatagaaactccccagtgatgaggatttacttgttgtaacaggacctgaggtatcagattgtctagaagctgcactggcctcactgcctttcttgggactcaacggtacagatgcttgttctcctggttctttctccttcccctttcgtcggatgggacttagagaaggggggtttgttagagaaggcaaggctgcctttattgccggtccaggagccacgtcgtccaggacatgtgcacaaatgttgatcaccttcagcaggtgggagaagagctgctccaccatgggcaccaaggcccggtcccccagggctggccagacctcctcttgcttggtggctgctgggttggcttcttcttcagaggcccatgaacttctcagagatttaggagcactggctgcaagcaagtttccggccaaaatcaaagcatcttgatgggctgagagatccaatgggaaccaagctgacgagagcagggtcagaatcatcgtggccatcccaacggtacagctcttcctagactcatcggaggcgctcagtggaggcactccacagtgccaacctaaactccaaatgcaaactgggaaggcagtggaaagaagacacaaagcttcacagcatccaaaagtgagtgctctcgtggttgatgtgatcagttcatgagaaactgctgcaataactcttgaaaggttattttccatagtgacatctgttatgcttggcagtaggttatagcctctgtatattctggttattgtgctgacggagaaatgagatggaggctgcgtctcatgcatgagaagtttcaggtaaacactgctttgatctcttgccacggccactactgggtcagcttgtccttggtcacatttataaaacagctttgggacaagcctaattaatgatgctgcagcaacatgtcgcaccctggggtcttcatccccaagcaaatggatgacaacattattgagcactcgttcttgcagctttaaaagccctgtataatgatgagcccctctgtgtaagttttctgcttttgcctccaaaaagctcaccagcctgaagtcaatctccgcaagggtttccagaagctctgtcctcaccagccaataggaactgttcctcagagtcagcacgtcgatgatcagctgcagtcctaactcactgtagctgctgctgcagagactcatgacacaatgcctcacagctgtacaggccagcttgcaagtgacagaagactcgtccttcagtgttttccgcagcaaaggaatgcaatccgccaaagaaaatgtgtttcctgtcagggttctaatggcgcccatccaatctcccacgtggaagcgggacctgctgaggatggagcagatgagggtcccacagagaatggcagtggctcctcgaacctgtgggtctccatgatcgatgtagttcaagatatctgagacatattgttcctcagggtattctgtggtgtcaagaggaactttatagagtttgctgaagaaagattctgggtggagagccacagctgctcccacacagctgagggccagggccttcacgctgaccctcacatcccggtccggaaccagcacattttttccccctgttagcaaaaatgaagcagataaaaggcggacacaatggacaagaggtgcagaatcatcatcagtggactgtccaatgtcacctttgatgcggcaaggcttgttttcttgatcacccggttcagtagcttcatctctcaacacaaatttatcaacactgctgtcagaaggctgcctgctgtgactcatgtttttcaataaatgtgcttgttgaagggccatggaagagttcctgaaggcctccgaggcttcgtcaggaagaacacctgtggcttcctcatcttcatcctggggctgtccaatctgcaggcccaaatactggttgtcggtaccgtctaacacaatttcagaactgtctgaaggggtgacagctgaatcaggcccttcggtggtggtctgggagctgtcgctgatgggcgaggaggcctgggtcccatcattcaggtccatggcagggtcagatgggacggcgctgacctggctggagctgtggctcaagatatcctcctcatccccatccgtggcagagcttgtcaagtcacagctggccagatccactgagtccgcctgcagcgtgtgctgtgaccgtggctgctccgtgatgatgtcgtgacctgctgaccctggagtggaaacccctgaagaagtagccagctctccactgatatcatccttcactgaggctgcaaaggcagagctgctgacatccgatctcgattcagagtcatcctccaaggcttcttcttctcctaagagcactttgcctttttgttttcttgaaaggacagggctgcatgaggaaccccctccagctataagttccacaatactcccactacggcttcggccaccagactcctccttagcggcggtaagctgcccaatgccccccactgtggtcagggcttgcagaagctcggggggaggcgttctgaagagctgctgcaacagctccagggctccggtcacaacattgtggtcttggtgctgtgtatgatgtaacgtcagttcataaacctggacaagctgctctgcagaaggagagacctccatttctttccgtgtcactccgaagctgcctttcaggcttgtatccttgacctgctgctgcagcaagggcaccaaatacctcagggtgagcagcacgccaagaatcagcagggtggagtgctcctcctcgacaggaaccagtaagcctaagagcacatttagtagccagctatagaaatactgtgtccttcttgagtgctggcagatgctcactgctgatccagcagctgtccgccgaatagtgggggagcttgacttcaggttcgctatgaaggcctttaacaaaaccttaatttcattgtcatttgcaaaattgccgaaagaagccataattttgggaacagctgcagccaaggtctcctggactgattcctcgggtctcttgcttgttcgacttaggcacggcagaaggttcaccaggtaaggcctgcatttctgaggccgaaccaggtgagccagctcggcaaacctccacagggcagcacgcaaactccgaggggcaccattctttttaatttctttatagagctcgagctgtaaccttggaagattagaatccatcaaagctttgataactttgttgaggcattcatcagccaccattctgacatccgactctgcgtcatcactgcacagcagaaaaagttccatagcgatgcccagaagtttctgaaattctggagaatttctgacagactgtgccactatgttttcacatattgtcagacaatgattcacacggtctttcttggtagctgaaagttctttctttggtcggtgcagcggctcctcagccacagccgggccgggtggtggcgggggcggcggcgggggcggctgcggctgaggcagcatcggctgtgcctgcggcggctgaggaagctgaggaggaggaggcggcggcggcggcggcggcggcggctgttgctgctgctgctgctgctgctgctgctggaaggacttgagagactcgaaggccttcatcagcttttccagggtcgccatggcggtctcccgcccggctaggcagtccccggaggcctcgggccgactcgcagcgccgctcagcaccggggcaatgaatggggctctgggccgcgggtaaaagcggaaccgaagcggccgtccatcttggacccgtcccggcagcccccgcggcgccttgc

SEQ ID NO: 11 - protein, 16 aa, Unknown
  source: /note="Description of Unknown: RFGF sequence"
AAVALLPAVLLALLAP

SEQ ID NO: 12 - protein, 11 aa, Unknown
  source: /note="Description of Unknown: RFGF analogue sequence"
AALLPVLLAAP

SEQ ID NO: 13 - protein, 13 aa, Human immunodeficiency virus
GRKKRRQRRRPPQ

SEQ ID NO: 14 - protein, 16 aa, Drosophila sp.
RQIKIWFQNRRMKWKK

SEQ ID NO: 15 - RNA, 21 nt, Artificial Sequence
  source: /note="Description of Artificial Sequence: Synthetic oligonucleotide"
ggacuaaaacuuuuuaucaaa

SEQ ID NO: 16 - RNA, 21 nt, Artificial Sequence
  source: /note="Description of Artificial Sequence: Synthetic oligonucleotide"
cucuguuaccagcuacuacau

SEQ ID NO: 17 - RNA, 21 nt, Artificial Sequence
  source: /note="Description of Artificial Sequence: Synthetic oligonucleotide"
ccugucccuucucuguuacca

SEQ ID NO: 18 - RNA, 21 nt, Artificial Sequence
  source: /note="Description of Artificial Sequence: Synthetic oligonucleotide"
uuugugagucuagcaucugau

SEQ ID NO: 19 - RNA, 21 nt, Artificial Sequence
  source: /note="Description of Artificial Sequence: Synthetic oligonucleotide"
gaucagugaagugguucgauu

SEQ ID NO: 20 - RNA, 21 nt, Artificial Sequence
  source: /note="Description of Artificial Sequence: Synthetic oligonucleotide"
ccucugguauggaaacucggu

SEQ ID NO: 21 - RNA, 21 nt, Artificial Sequence
  source: /note="Description of Artificial Sequence: Synthetic oligonucleotide"
agaguccuuggucaagcuaau

SEQ ID NO: 22 - RNA, 21 nt, Artificial Sequence
  source: /note="Description of Artificial Sequence: Synthetic oligonucleotide"
uucaaccuaagccuuuuggcu

SEQ ID NO: 23 - RNA, 21 nt, Artificial Sequence
  source: /note="Description of Artificial Sequence: Synthetic oligonucleotide"
ugacagaacuacggagagugu

SEQ ID NO: 24 - RNA, 21 nt, Artificial Sequence
  source: /note="Description of Artificial Sequence: Synthetic oligonucleotide"
cuccaugugugcuugucacau

SEQ ID NO: 25 - RNA, 21 nt, Artificial Sequence
  source: /note="Description of Artificial Sequence: Synthetic oligonucleotide"
cgaacguacccaguuugaaau

SEQ ID NO: 26 - RNA, 21 nt, Artificial Sequence
  source: /note="Description of Artificial Sequence: Synthetic oligonucleotide"
auaccacaucauaccagucuu

SEQ ID NO: 27 - RNA, 21 nt, Artificial Sequence
  source: /note="Description of Artificial Sequence: Synthetic oligonucleotide"
cugcaugugacaaaguuuauu

SEQ ID NO: 28 - RNA, 21 nt, Artificial Sequence
  source: /note="Description of Artificial Sequence: Synthetic oligonucleotide"
uucacuccuguucgcaguuuc

SEQ ID NO: 29 - RNA, 21 nt, Artificial Sequence
  source: /note="Description of Artificial Sequence: Synthetic oligonucleotide"
cugucccuucucuguuaccau

SEQ ID NO: 30 - RNA, 21 nt, Artificial Sequence
  source: /note="Description of Artificial Sequence: Synthetic oligonucleotide"
ucugagaaugggacucaauuu

SEQ ID NO: 31 - RNA, 21 nt, Artificial Sequence
  source: /note="Description of Artificial Sequence: Synthetic oligonucleotide"
ucagaagaugagauccucauu

SEQ ID NO: 32 - RNA, 21 nt, Artificial Sequence
  source: /note="Description of Artificial Sequence: Synthetic oligonucleotide"
ccacugaaggcucucgauacu

SEQ ID NO: 33 - RNA, 21 nt, Artificial Sequence
  source: /note="Description of Artificial Sequence: Synthetic oligonucleotide"
gagucugugauuguagcuauu

SEQ ID NO: 34 - RNA, 21 nt, Artificial Sequence
  source: /note="Description of Artificial Sequence: Synthetic oligonucleotide"
ucauggcauuugauccaugau

SEQ ID NO: 35 - RNA, 21 nt, Artificial Sequence
  source: /note="Description of Artificial Sequence: Synthetic oligonucleotide"
acggcauccucuauguguugu

SEQ ID NO: 36 - RNA, 21 nt, Artificial Sequence
  source: /note="Description of Artificial Sequence: Synthetic oligonucleotide"
ugagcgagauugcuaauggcu

SEQ ID NO: 37 - RNA, 21 nt, Artificial Sequence
  source: /note="Description of Artificial Sequence: Synthetic oligonucleotide"
cgcugacagaacuacggagau

SEQ ID NO: 38 - RNA, 21 nt, Artificial Sequence
  source: /note="Description of Artificial Sequence: Synthetic oligonucleotide"
aagcaggucacauacuccaau

SEQ ID NO: 39 - RNA, 21 nt, Artificial Sequence
  source: /note="Description of Artificial Sequence: Synthetic oligonucleotide"
ccaguuguuagugacuaucuu

SEQ ID NO: 40 - RNA, 21 nt, Artificial Sequence
  source: /note="Description of Artificial Sequence: Synthetic oligonucleotide"
ucagugaagugguucgaucuu

SEQ ID NO: 41 - RNA, 21 nt, Artificial Sequence
  source: /note="Description of Artificial Sequence: Synthetic oligonucleotide"
aucagugaagugguucgaucu

SEQ ID NO: 42 - RNA, 21 nt, Artificial Sequence
  source: /note="Description of Artificial Sequence: Synthetic oligonucleotide"
ccaugugugcuugucacacuu

SEQ ID NO: 43 - RNA, 21 nt, Artificial Sequence
  source: /note="Description of Artificial Sequence: Synthetic oligonucleotide"
uuucagcaucugugauacaga

SEQ ID NO: 44 - RNA, 21 nt, Artificial Sequence
  source: /note="Description of Artificial Sequence: Synthetic oligonucleotide"
aaggcucucgauaccagauuu

SEQ ID NO: 45 - RNA, 21 nt, Artificial Sequence
  source: /note="Description of Artificial Sequence: Synthetic oligonucleotide"
uagaugacuucuuuccaccuu

SEQ ID NO: 46 - RNA, 21 nt, Artificial Sequence
  source: /note="Description of Artificial Sequence: Synthetic oligonucleotide"
guuaacagcuauacucguguu

SEQ ID NO: 47 - RNA, 21 nt, Artificial Sequence
  source: /note="Description of Artificial Sequence: Synthetic oligonucleotide"
uccaaccucaaaggaauagcu

SEQ ID NO: 48 - RNA, 21 nt, Artificial Sequence
  source: /note="Description of Artificial Sequence: Synthetic oligonucleotide"
uugcuaauggccaaaagaguu

SEQ ID NO: 49 - RNA, 21 nt, Artificial Sequence
  source: /note="Description of Artificial Sequence: Synthetic oligonucleotide"
cugcuguccaaccucaaagga

SEQ ID NO: 50 - RNA, 21 nt, Artificial Sequence
  source: /note="Description of Artificial Sequence: Synthetic oligonucleotide"
ccgaacguacccaguuugaaa

SEQ ID NO: 51 - RNA, 21 nt, Artificial Sequence
  source: /note="Description of Artificial Sequence: Synthetic oligonucleotide"
aaguagacucagauauacaaa

SEQ ID NO: 52 - RNA, 21 nt, Artificial Sequence
  source: /note="Description of Artificial Sequence: Synthetic oligonucleotide"
gcucauuccaguuguuaguga

SEQ ID NO: 53 - RNA, 21 nt, Artificial Sequence
  source: /note="Description of Artificial Sequence: Synthetic oligonucleotide"
cagugaagugguucgaucucu

SEQ ID NO: 54 - RNA, 21 nt, Artificial Sequence
  source: /note="Description of Artificial Sequence: Synthetic oligonucleotide"
gagauugcuaauggccaaaau

SEQ ID NO: 55 - RNA, 21 nt, Artificial Sequence
  source: /note="Description of Artificial Sequence: Synthetic oligonucleotide"
gaguccuuggucaagcuaagu

SEQ ID NO: 56 - RNA, 21 nt, Artificial Sequence
  source: /note="Description of Artificial Sequence: Synthetic oligonucleotide"
gcucucgauaccagauuugga

SEQ ID NO: 57 - RNA, 21 nt, Artificial Sequence
  source: /note="Description of Artificial Sequence: Synthetic oligonucleotide"
caugugacaaaguuuauggaa

SEQ ID NO: 58 - RNA, 21 nt, Artificial Sequence
  source: /note="Description of Artificial Sequence: Synthetic oligonucleotide"
uccucugguauggaaacucgu

SEQ ID NO: 59 - RNA, 21 nt, Artificial Sequence
  source: /note="Description of Artificial Sequence: Synthetic oligonucleotide"
caaccucaaaggaauagccca

SEQ ID NO: 60 - RNA, 21 nt, Artificial Sequence
  source: /note="Description of Artificial Sequence: Synthetic oligonucleotide"
ugcuaauggccaaaagagucu

SEQ ID NO: 61 - RNA, 21 nt, Artificial Sequence
  source: /note="Description of Artificial Sequence: Synthetic oligonucleotide"
ccuaugcccguguaaaguguu

SEQ ID NO: 62 - RNA, 21 nt, Artificial Sequence
  source: /note="Description of Artificial Sequence: Synthetic oligonucleotide"
gacgcugacagaacuacggau

SEQ ID NO: 63 - RNA, 21 nt, Artificial Sequence
  source: /note="Description of Artificial Sequence: Synthetic oligonucleotide"
acucagauauacaaaaccuca

SEQ ID NO: 64 - RNA, 21 nt, Artificial Sequence
  source: /note="Description of Artificial Sequence: Synthetic oligonucleotide"
uucuuuccaccucaagauguu

SEQ ID NO: 65 - RNA, 21 nt, Artificial Sequence
  source: /note="Description of Artificial Sequence: Synthetic oligonucleotide"
cagcgagucugugauuguagu

SEQ ID NO: 66 - RNA, 21 nt, Artificial Sequence
  source: /note="Description of Artificial Sequence: Synthetic oligonucleotide"
agacucagauauacaaaaccu

SEQ ID NO: 67 - RNA, 21 nt, Artificial Sequence
  source: /note="Description of Artificial Sequence: Synthetic oligonucleotide"
uugugagucuagcaucugaga

SEQ ID NO: 68 - RNA, 21 nt, Artificial Sequence
  source: /note="Description of Artificial Sequence: Synthetic oligonucleotide"
uugauauucacuccuguucgu

SEQ ID NO: 69 - RNA, 21 nt, Artificial Sequence
  source: /note="Description of Artificial Sequence: Synthetic oligonucleotide"
uagcuacucagucuagucggu

SEQ ID NO: 70 - RNA, 21 nt, Artificial Sequence
  source: /note="Description of Artificial Sequence: Synthetic oligonucleotide"
ccugugucuccagucaauucu

SEQ ID NO: 71 - RNA, 21 nt, Artificial Sequence
  source: /note="Description of Artificial Sequence: Synthetic oligonucleotide"
agggaacaugcacuauguugu

SEQ ID NO: 72 - RNA, 21 nt, Artificial Sequence
  source: /note="Description of Artificial Sequence: Synthetic oligonucleotide"
agccauugcaguacaaccugu

SEQ ID NO: 73 - RNA, 21 nt, Artificial Sequence
  source: /note="Description of Artificial Sequence: Synthetic oligonucleotide"
ugcaagguucccuaccaaaca

SEQ ID NO: 74 - RNA, 21 nt, Artificial Sequence
  source: /note="Description of Artificial Sequence: Synthetic oligonucleotide"
acagauguguggaguaaugcu

SEQ ID NO: 75 - RNA, 21 nt, Artificial Sequence
  source: /note="Description of Artificial Sequence: Synthetic oligonucleotide"
gcugcaugugacaaaguuuau

SEQ ID NO: 76 - RNA, 21 nt, Artificial Sequence
  source: /note="Description of Artificial Sequence: Synthetic oligonucleotide"
gugcugcaugugacaaaguuu

SEQ ID NO: 77 - RNA, 21 nt, Artificial Sequence
  source: /note="Description of Artificial Sequence: Synthetic oligonucleotide"
ugcaugugacaaaguuuaugu

SEQ ID NO: 78 - RNA, 21 nt, Artificial Sequence
  source: /note="Description of Artificial Sequence: Synthetic oligonucleotide"
aguuaacagcuauacucgugu

SEQ ID NO: 79 - RNA, 21 nt, Artificial Sequence
  source: /note="Description of Artificial Sequence: Synthetic oligonucleotide"
gcucggaguucaaccuaagcu

SEQ ID NO: 80 - RNA, 21 nt, Artificial Sequence
  source: /note="Description of Artificial Sequence: Synthetic oligonucleotide"
auccugaucagugaagugguu

SEQ ID NO: 81 - RNA, 21 nt, Artificial Sequence
  source: /note="Description of Artificial Sequence: Synthetic oligonucleotide"
cagucagcuuugugagucuau

SEQ ID NO: 82 - RNA, 21 nt, Artificial Sequence
  source: /note="Description of Artificial Sequence: Synthetic oligonucleotide"
gauauucacuccuguucgcau

SEQ ID NO: 83 - RNA, 21 nt, Artificial Sequence
  source: /note="Description of Artificial Sequence: Synthetic oligonucleotide"
uugaugcacucuccuagucuu

SEQ ID NO: 84 - RNA, 21 nt, Artificial Sequence
  source: /note="Description of Artificial Sequence: Synthetic oligonucleotide"
cagauauacaaaaccucaguu

SEQ ID NO: 85 - RNA, 21 nt, Artificial Sequence
  source: /note="Description of Artificial Sequence: Synthetic oligonucleotide"
uggcaugagcgagauugcuaa

SEQ ID NO: 86 - RNA, 21 nt, Artificial Sequence
  source: /note="Description of Artificial Sequence: Synthetic oligonucleotide"
acagguggaugugaaccuuuu

SEQ ID NO: 87 - RNA, 21 nt, Artificial Sequence
  source: /note="Description of Artificial Sequence: Synthetic oligonucleotide"
gagcucggaguucaaccuaau

SEQ ID NO: 88 - RNA, 21 nt, Artificial Sequence
  source: /note="Description of Artificial Sequence: Synthetic oligonucleotide"
ugucccuuuguaucuucugca

SEQ ID NO: 89 - RNA, 21 nt, Artificial Sequence
  source: /note="Description of Artificial Sequence: Synthetic oligonucleotide"
acuccucaugguagauguuca

SEQ ID NO: 90 - RNA, 21 nt, Artificial Sequence
  source: /note="Description of Artificial Sequence: Synthetic oligonucleotide"
aggcucucgauaccagauuug

SEQ ID NO: 91 - RNA, 21 nt, Artificial Sequence
  source: /note="Description of Artificial Sequence: Synthetic oligonucleotide"
cucggaguucaaccuaagccu

SEQ ID NO: 92 - RNA, 21 nt, Artificial Sequence
  source: /note="Description of Artificial Sequence: Synthetic oligonucleotide"
cuguccaaccucaaaggaaua

SEQ ID NO: 93 - RNA, 21 nt, Artificial Sequence
  source: /note="Description of Artificial Sequence: Synthetic oligonucleotide"
cugagaaugggacucaauuuu

SEQ ID NO: 94 - RNA, 21 nt, Artificial Sequence
  source: /note="Description of Artificial Sequence: Synthetic oligonucleotide"
cgucauccugaucagugaagu

SEQ ID NO: 95 - RNA, 21 nt, Artificial Sequence
  source: /note="Description of Artificial Sequence: Synthetic oligonucleotide"
caaaggugucucugagcuauu

SEQ ID NO: 96 - RNA, 21 nt, Artificial Sequence
  source: /note="Description of Artificial Sequence: Synthetic oligonucleotide"
cuacuacaggugcucuuauca

SEQ ID NO: 97 - RNA, 21 nt, Artificial Sequence
  source: /note="Description of Artificial Sequence: Synthetic oligonucleotide"
ggcaugagcgagauugcuaau

SEQ ID NO: 98 - RNA, 21 nt, Artificial Sequence
  source: /note="Description of Artificial Sequence: Synthetic oligonucleotide"
uggcaggagugcuuugcaauu

SEQ ID NO: 99 - RNA, 21 nt, Artificial Sequence
  source: /note="Description of Artificial Sequence: Synthetic oligonucleotide"
cucgauaccagauuuggaaga

SEQ ID NO: 100 - RNA, 21 nt, Artificial Sequence
  source: /note="Description of Artificial Sequence: Synthetic oligonucleotide"
uaguuaacagcuauacucguu

SEQ ID NO: 101 - RNA, 21 nt, Artificial Sequence
  source: /note="Description of Artificial Sequence: Synthetic oligonucleotide"
uccucaugguagauguucaua

SEQ ID NO: 102 - RNA, 21 nt, Artificial Sequence
  source: /note="Description of Artificial Sequence: Synthetic oligonucleotide"
auucacuccuguucgcaguuu

SEQ ID NO: 103 - RNA, 21 nt, Artificial Sequence
  source: /note="Description of Artificial Sequence: Synthetic oligonucleotide"
agauauacaaaaccucaguca

SEQ ID NO: 104 - RNA, 21 nt, Artificial Sequence
  source: /note="Description of Artificial Sequence: Synthetic oligonucleotide"
guucaaccuaagccuuuuggu

SEQ ID NO: 105 - RNA, 21 nt, Artificial Sequence
  source: /note="Description of Artificial Sequence: Synthetic oligonucleotide"
gcugacagaacuacggagagu

SEQ ID NO: 106 - RNA, 21 nt, Artificial Sequence
  source: /note="Description of Artificial Sequence: Synthetic oligonucleotide"
cugcacauguacccuucagga

SEQ ID NO: 107 - RNA, 21 nt, Artificial Sequence
  source: /note="Description of Artificial Sequence: Synthetic oligonucleotide"
ucauccugaucagugaagugu

SEQ ID NO: 108 - RNA, 21 nt, Artificial Sequence
  source: /note="Description of Artificial Sequence: Synthetic oligonucleotide"
gcaugagcgagauugcuaauu

SEQ ID NO: 109 - RNA, 21 nt, Artificial Sequence
  source: /note="Description of Artificial Sequence: Synthetic oligonucleotide"
cagggaacaugcacuauguuu

SEQ ID NO: 110 - RNA, 21 nt, Artificial Sequence
  source: /note="Description of Artificial Sequence: Synthetic oligonucleotide"
uuguucuuucucguauucagu

SEQ ID NO: 111 - RNA, 21 nt, Artificial Sequence
  source: /note="Description of Artificial Sequence: Synthetic oligonucleotide"
ugcagauaagaaugcuauuca

SEQ ID NO: 112 - RNA, 21 nt, Artificial Sequence
  source: /note="Description of Artificial Sequence: Synthetic oligonucleotide"
caaacucuauaaaguuccucu

SEQ ID NO: 113 - RNA, 21 nt, Artificial Sequence
  source: /note="Description of Artificial Sequence: Synthetic oligonucleotide"
aagauauuguucuuucucgua

SEQ ID NO: 114 - RNA, 21 nt, Artificial Sequence
  source: /note="Description of Artificial Sequence: Synthetic oligonucleotide"
cugaaacuucucaugcaugau

SEQ ID NO: 115 - RNA, 21 nt, Artificial Sequence
  source: /note="Description of Artificial Sequence: Synthetic oligonucleotide"
agaaugcuauucauaaucaca

SEQ ID NO: 116 - RNA, 21 nt, Artificial Sequence
  source: /note="Description of Artificial Sequence: Synthetic oligonucleotide"
ucaacaaaguuaucaaagcuu

SEQ ID NO: 117 - RNA, 21 nt, Artificial Sequence
  source: /note="Description of Artificial Sequence: Synthetic oligonucleotide"
gaacugacguuacaucauaca

SEQ ID NO: 118 - RNA, 21 nt, Artificial Sequence
  source: /note="Description of Artificial Sequence: Synthetic oligonucleotide"
ccugaaauccugcuuuagucu

SEQ ID NO: 119 - RNA, 21 nt, Artificial Sequence
  source: /note="Description of Artificial Sequence: Synthetic oligonucleotide"
cauugucugacaauaugugaa

SEQ ID NO: 120 - RNA, 21 nt, Artificial Sequence
  source: /note="Description of Artificial Sequence: Synthetic oligonucleotide"
cagucguacucaguuugaaga

SEQ ID NO: 121 - RNA, 21 nt, Artificial Sequence
  source: /note="Description of Artificial Sequence: Synthetic oligonucleotide"
agcuacucagucuagucgggu

SEQ ID NO: 122 - RNA, 21 nt, Artificial Sequence
  source: /note="Description of Artificial Sequence: Synthetic oligonucleotide"
uuugaaccucuuguuauaaaa

SEQ ID NO: 123 - RNA, 21 nt, Artificial Sequence
  source: /note="Description of Artificial Sequence: Synthetic oligonucleotide"
guuugaaccucuuguuauaaa

SEQ ID NO: 124 - RNA, 21 nt, Artificial Sequence
  source: /note="Description of Artificial Sequence: Synthetic oligonucleotide"
cuugaacuacaucgaucaugu

SEQ ID NO: 125 - RNA, 21 nt, Artificial Sequence
  source: /note="Description of Artificial Sequence: Synthetic oligonucleotide"
uguucuuucucguauucagga

SEQ ID NO: 126 - RNA, 21 nt, Artificial Sequence
  source: /note="Description of Artificial Sequence: Synthetic oligonucleotide"
gcagcuucuagacaaucugau

SEQ ID NO: 127 - RNA, 21 nt, Artificial Sequence
  source: /note="Description of Artificial Sequence: Synthetic oligonucleotide"
uguuugaaccucuuguuauaa

SEQ ID NO: 128 - RNA, 21 nt, Artificial Sequence
  source: /note="Description of Artificial Sequence: Synthetic oligonucleotide"
gaaaaccuuucaacuccaacu

SEQ ID NO: 129 - RNA, 21 nt, Artificial Sequence
  source: /note="Description of Artificial Sequence: Synthetic oligonucleotide"
acugacguuacaucauacaca

SEQ ID NO: 130 - RNA, 21 nt, Artificial Sequence
  source: /note="Description of Artificial Sequence: Synthetic oligonucleotide"
ccugcuuuagucgagaaccaa

SEQ ID NO: 131 - RNA, 21 nt, Artificial Sequence
  source: /note="Description of Artificial Sequence: Synthetic oligonucleotide"
uggauucagaucagguguuua

SEQ ID NO: 132 - RNA, 21 nt, Artificial Sequence
  source: /note="Description of Artificial Sequence: Synthetic oligonucleotide"
cugcugacuuguuuacgaaau

SEQ ID NO: 133 - RNA, 21 nt, Artificial Sequence
  source: /note="Description of Artificial Sequence: Synthetic oligonucleotide"
ugguguugaugcacucuccua

SEQ ID NO: 134 - RNA, 21 nt, Artificial Sequence
  source: /note="Description of Artificial Sequence: Synthetic oligonucleotide"
cagaucauuggaauuccuaaa

SEQ ID NO: 135 - RNA, 21 nt, Artificial Sequence
  source: /note="Description of Artificial Sequence: Synthetic oligonucleotide"
guucuuucucguauucaggau

SEQ ID NO: 136 - RNA, 21 nt, Artificial Sequence
  source: /note="Description of Artificial Sequence: Synthetic oligonucleotide"
agcuucuagacaaucugauau

SEQ ID NO: 137 - RNA, 21 nt, Artificial Sequence
  source: /note="Description of Artificial Sequence: Synthetic oligonucleotide"
auuuucaagguuucuauuaca

SEQ ID NO: 138 - RNA, 21 nt, Artificial Sequence
  source: /note="Description of Artificial Sequence: Synthetic oligonucleotide"
cuucuagacaaucugauaccu

SEQ ID NO: 139 - RNA, 21 nt, Artificial Sequence
  source: /note="Description of Artificial Sequence: Synthetic oligonucleotide"
agcuuuaaaacaguacacgau

SEQ ID NO: 140 - RNA, 21 nt, Artificial Sequence
  source: /note="Description of Artificial Sequence: Synthetic oligonucleotide"
gcuuugauggauucuaaucuu

SEQ ID NO: 141 - RNA, 21 nt, Artificial Sequence
  source: /note="Description of Artificial Sequence: Synthetic oligonucleotide"
cugacguuacaucauacacau

SEQ ID NO: 142 - RNA, 21 nt, Artificial Sequence
  source: /note="Description of Artificial Sequence: Synthetic oligonucleotide"
cugcuuuagucgagaaccaau

SEQ ID NO: 143 - RNA, 21 nt, Artificial Sequence
  source: /note="Description of Artificial Sequence: Synthetic oligonucleotide"
uguucgucacuccaaacacaa

SEQ ID NO: 144 - RNA, 21 nt, Artificial Sequence
  source: /note="Description of Artificial Sequence: Synthetic oligonucleotide"
ugacuuguuuacgaaaugucu

SEQ ID NO: 145 - RNA, 21 nt, Artificial Sequence
  source: /note="Description of Artificial Sequence: Synthetic oligonucleotide"
guguugaugcacucuccuagu

SEQ ID NO: 146 - RNA, 21 nt, Artificial Sequence
  source: /note="Description of Artificial Sequence: Synthetic oligonucleotide"
gauucuaaucuuccaagguua

SEQ ID NO: 147 - RNA, 21 nt, Artificial Sequence
  source: /note="Description of Artificial Sequence: Synthetic oligonucleotide"
cucguugugaaaaccuuucaa

SEQ ID NO: 148 - RNA, 21 nt, Artificial Sequence
  source: /note="Description of Artificial Sequence: Synthetic oligonucleotide"
ucuagacaaucugauaccuca

SEQ ID NO: 149 - RNA, 21 nt, Artificial Sequence
  source: /note="Description of Artificial Sequence: Synthetic oligonucleotide"
caacaaaguuaucaaagcuuu

SEQ ID NO: 150 - RNA, 21 nt, Artificial Sequence
  source: /note="Description of Artificial Sequence: Synthetic oligonucleotide"
cagguccuguuacaacaagua

SEQ ID NO: 151 - RNA, 21 nt, Artificial Sequence
  source: /note="Description of Artificial Sequence: Synthetic oligonucleotide"
guucaguuacggguuaauuau

SEQ ID NO: 152 - RNA, 21 nt, Artificial Sequence
  source: /note="Description of Artificial Sequence: Synthetic oligonucleotide"
ccagucguacucaguuugaau

SEQ ID NO: 153 - RNA, 21 nt, Artificial Sequence
  source: /note="Description of Artificial Sequence: Synthetic oligonucleotide"
ucugaaauuguguuagacggu

SEQ ID NO: 154 - RNA, 21 nt, Artificial Sequence
  source: /note="Description of Artificial Sequence: Synthetic oligonucleotide"
ggcaacuguuuguguucaaca

SEQ ID NO: 155 - RNA, 21 nt, Artificial Sequence
  source: /note="Description of Artificial Sequence: Synthetic oligonucleotide"
uucgucacuccaaacacaauu

SEQ ID NO: 156 - RNA, 21 nt, Artificial Sequence
  source: /note="Description of Artificial Sequence: Synthetic oligonucleotide"
cugacauuuccguuguacauu

SEQ ID NO: 157 - RNA, 21 nt, Artificial Sequence
  source: /note="Description of Artificial Sequence: Synthetic oligonucleotide"
ccacugccaagugcccuuuau

SEQ ID NO: 158 - RNA, 21 nt, Artificial Sequence
  source: /note="Description of Artificial Sequence: Synthetic oligonucleotide"
cagguuuaugaacugacguua

SEQ ID NO: 159 - RNA, 21 nt, Artificial Sequence
  source: /note="Description of Artificial Sequence: Synthetic oligonucleotide"
auucuaaucuuccaagguuau

SEQ ID NO: 160 - RNA, 21 nt, Artificial Sequence
  source: /note="Description of Artificial Sequence: Synthetic oligonucleotide"
caaguaaauccucaucacugu

SEQ ID NO: 161 - RNA, 21 nt, Artificial Sequence
  source: /note="Description of Artificial Sequence: Synthetic oligonucleotide"
uugauggauucuaaucuucca

SEQ ID NO: 162 - RNA, 21 nt, Artificial Sequence
  source: /note="Description of Artificial Sequence: Synthetic oligonucleotide"
cuucauaccucaaacugcauu

SEQ ID NO: 163 - RNA, 21 nt, Artificial Sequence
  source: /note="Description of Artificial Sequence: Synthetic oligonucleotide"
uauuggcuuuguauugaaaca

SEQ ID NO: 164 - RNA, 21 nt, Artificial Sequence
  source: /note="Description of Artificial Sequence: Synthetic oligonucleotide"
ugcugacuuguuuacgaaauu

SEQ ID NO: 165 - RNA, 21 nt, Artificial Sequence
  source: /note="Description of Artificial Sequence: Synthetic oligonucleotide"
cugaaauuguguuagacggua

SEQ ID NO: 166 - RNA, 21 nt, Artificial Sequence
  source: /note="Description of Artificial Sequence: Synthetic oligonucleotide"
uucauaaucacauucguuugu

SEQ ID NO: 167 - RNA, 21 nt, Artificial Sequence
  source: /note="Description of Artificial Sequence: Synthetic oligonucleotide"
caauucagucucguugugaaa

SEQ ID NO: 168 - RNA, 21 nt, Artificial Sequence
  source: /note="Description of Artificial Sequence: Synthetic oligonucleotide"
ccagguuuaugaacugacguu

SEQ ID NO: 169 - RNA, 21 nt, Artificial Sequence
  source: /note="Description of Artificial Sequence: Synthetic oligonucleotide"
ccuccagggauugguaugugu

SEQ ID NO: 170 - RNA, 21 nt, Artificial Sequence
  source: /note="Description of Artificial Sequence: Synthetic oligonucleotide"
uuucuucagcaaacucuauaa

SEQ ID NO: 171 - RNA, 21 nt, Artificial Sequence
  source: /note="Description of Artificial Sequence: Synthetic oligonucleotide"
uguucccaaaauuauggcuuu

SEQ ID NO: 172 - RNA, 21 nt, Artificial Sequence
  source: /note="Description of Artificial Sequence: Synthetic oligonucleotide"
uuucuaucaucuuccuucaua

SEQ ID NO: 173 - RNA, 21 nt, Artificial Sequence
  source: /note="Description of Artificial Sequence: Synthetic oligonucleotide"
cuuuaaggaguucaucuaccu

SEQ ID NO: 174 - RNA, 21 nt, Artificial Sequence
  source: /note="Description of Artificial Sequence: Synthetic oligonucleotide"
uguuuguguucaacaauuguu

SEQ ID NO: 175 - RNA, 21 nt, Artificial Sequence
  source: /note="Description of Artificial Sequence: Synthetic oligonucleotide"
acuguucaacuguggauaucu

SEQ ID NO: 176 - RNA, 21 nt, Artificial Sequence
  source: /note="Description of Artificial Sequence: Synthetic oligonucleotide"
uaacguaacucuuucuaugcu

SEQ ID NO: 177 - RNA, 21 nt, Artificial Sequence
  source: /note="Description of Artificial Sequence: Synthetic oligonucleotide"
ucugaggaacaguuccuauuu

SEQ ID NO: 178 - RNA, 21 nt, Artificial Sequence
  source: /note="Description of Artificial Sequence: Synthetic oligonucleotide"
ucauaaucacauucguuuguu

SEQ ID NO: 179 - RNA, 21 nt, Artificial Sequence
  source: /note="Description of Artificial Sequence: Synthetic oligonucleotide"
auggauucuaaucuuccaagu

SEQ ID NO: 180 - RNA, 21 nt, Artificial Sequence
  source: /note="Description of Artificial Sequence: Synthetic oligonucleotide"
ugaacugacguuacaucauau

SEQ ID NO: 181 - RNA, 21 nt, Artificial Sequence
  source: /note="Description of Artificial Sequence: Synthetic oligonucleotide"
ucuauaaaguuccucuugaca

SEQ ID NO: 182 - RNA, 21 nt, Artificial Sequence
  source: /note="Description of Artificial Sequence: Synthetic oligonucleotide"
gcuauucauaaucacauucgu

SEQ ID NO: 183 - RNA, 21 nt, Artificial Sequence
  source: /note="Description of Artificial Sequence: Synthetic oligonucleotide"
gcuacuaaaugugcucuuagu

SEQ ID NO: 184 - RNA, 21 nt, Artificial Sequence
  source: /note="Description of Artificial Sequence: Synthetic oligonucleotide"
gcuuuaaaacaguacacgacu

SEQ ID NO: 185 - RNA, 21 nt, Artificial Sequence
  source: /note="Description of Artificial Sequence: Synthetic oligonucleotide"
agguuuaugaacugacguuau

SEQ ID NO: 186 - RNA, 21 nt, Artificial Sequence
  source: /note="Description of Artificial Sequence: Synthetic oligonucleotide"
ucaacaauuguugaagacucu

SEQ ID NO: 187 - RNA, 21 nt, Artificial Sequence
  source: /note="Description of Artificial Sequence: Synthetic oligonucleotide"
gcaacauacuuucuauugcca

SEQ ID NO: 188 - RNA, 21 nt, Artificial Sequence
  source: /note="Description of Artificial Sequence: Synthetic oligonucleotide"
auuuccguuguacauguuccu

SEQ ID NO: 189 - RNA, 21 nt, Artificial Sequence
  source: /note="Description of Artificial Sequence: Synthetic oligonucleotide"
cuccgucagcacaauaaccau

SEQ ID NO: 190 - RNA, 21 nt, Artificial Sequence
  source: /note="Description of Artificial Sequence: Synthetic oligonucleotide"
ugguucaguuacggguuaauu

SEQ ID NO: 191 - RNA, 21 nt, Artificial Sequence
  source: /note="Description of Artificial Sequence: Synthetic oligonucleotide"
uucuaaucuuccaagguuaca

SEQ ID NO: 192 - RNA, 21 nt, Artificial Sequence
  source: /note="Description of Artificial Sequence: Synthetic oligonucleotide"
gaguauuguggaacuuauagu

SEQ ID NO: 193 - RNA, 21 nt, Artificial Sequence
  source: /note="Description of Artificial Sequence: Synthetic oligonucleotide"
gauauuguucuuucucguauu

SEQ ID NO: 194 - RNA, 21 nt, Artificial Sequence
  source: /note="Description of Artificial Sequence: Synthetic oligonucleotide"
cuagacaaucugauaccucau

SEQ ID NO: 195 - RNA, 21 nt, Artificial Sequence
  source: /note="Description of Artificial Sequence: Synthetic oligonucleotide"
cgccuuuuaucugcuucguuu

SEQ ID NO: 196 - RNA, 21 nt, Artificial Sequence
  source: /note="Description of Artificial Sequence: Synthetic oligonucleotide"
uaugaacgcuaucauucaaaa

SEQ ID NO: 197 - RNA, 21 nt, Artificial Sequence
  source: /note="Description of Artificial Sequence: Synthetic oligonucleotide"
ugaaauuguguuagacgguau

SEQ ID NO: 198 - RNA, 21 nt, Artificial Sequence
  source: /note="Description of Artificial Sequence: Synthetic oligonucleotide"
aucuucaagucuggaauguuu

SEQ ID NO: 199 - RNA, 21 nt, Artificial Sequence
  source: /note="Description of Artificial Sequence: Synthetic oligonucleotide"
uccguuguacauguuccuguu

SEQ ID NO: 200 - RNA, 21 nt, Artificial Sequence
  source: /note="Description of Artificial Sequence: Synthetic oligonucleotide"
gcuucuagacaaucugauacu

SEQ ID NO: 201 - RNA, 21 nt, Artificial Sequence
  source: /note="Description of Artificial Sequence: Synthetic oligonucleotide"
uucaguuacggguuaauuacu

SEQ ID NO: 202 - RNA, 21 nt, Artificial Sequence
  source: /note="Description of Artificial Sequence: Synthetic oligonucleotide"
caugcaagacucacuuagucu

SEQ ID NO: 203 - RNA, 21 nt, Artificial Sequence
  source: /note="Description of Artificial Sequence: Synthetic oligonucleotide"
gaugacucugaaucgagaucu

SEQ ID NO: 204 - RNA, 21 nt, Artificial Sequence
  source: /note="Description of Artificial Sequence: Synthetic oligonucleotide"
aggcuauaaccuacuaccaau

SEQ ID NO: 205 - RNA, 21 nt, Artificial Sequence
  source: /note="Description of Artificial Sequence: Synthetic oligonucleotide"
acucugaaucgagaucggauu

SEQ ID NO: 206 - RNA, 21 nt, Artificial Sequence
  source: /note="Description of Artificial Sequence: Synthetic oligonucleotide"
accuacuaccaagcauaacau

SEQ ID NO: 207 - RNA, 21 nt, Artificial Sequence
  source: /note="Description of Artificial Sequence: Synthetic oligonucleotide"
ucugaaucgagaucggauguu

SEQ ID NO: 208 - RNA, 21 nt, Artificial Sequence
  source: /note="Description of Artificial Sequence: Synthetic oligonucleotide"
agguccuguuacaacaaguaa

SEQ ID NO: 209 - RNA, 21 nt, Artificial Sequence
  source: /note="Description of Artificial Sequence: Synthetic oligonucleotide"
acagcaguguugauaaauuug

SEQ ID NO: 210 - RNA, 21 nt, Artificial Sequence
  source: /note="Description of Artificial Sequence: Synthetic oligonucleotide"
gguccuguuacaacaaguaaa

SEQ ID NO: 211 - RNA, 21 nt, Artificial Sequence
  source: /note="Description of Artificial Sequence: Synthetic oligonucleotide"
uugaacuacaucgaucaugga

SEQ ID NO: 212 - RNA, 21 nt, Artificial Sequence
  source: /note="Description of Artificial Sequence: Synthetic oligonucleotide"
acucggaguucaaccuaagcu

SEQ ID NO: 213 - RNA, 21 nt, Artificial Sequence
  source: /note="Description of Artificial Sequence: Synthetic oligonucleotide"
cucugaggaacaguuccuauu

SEQ ID NO: 214 - RNA, 21 nt, Artificial Sequence
  source: /note="Description of Artificial Sequence: Synthetic oligonucleotide"
cugaggaacaguuccuauugu

SEQ ID NO: 215 - RNA, 21 nt, Artificial Sequence
  source: /note="Description of Artificial Sequence: Synthetic oligonucleotide"
aucauuauacagggcuuuuaa

SEQ ID NO: 216 - RNA, 23 nt, Artificial Sequence
  source: /note="Description of Artificial Sequence: Synthetic oligonucleotide"
uuugauaaaaaguuuuagucccu

SEQ ID NO: 217 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagtagcugguaacagagaa

SEQ ID NO: 218 - RNA, 23 nt, Artificial Sequence
  source: /note="Description of Artificial Sequence: Synthetic oligonucleotide"
ugguaacagagaagggacaggau

SEQ ID NO: 219 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucagatgcuagacucacaaagc

SEQ ID NO: 220 - RNA, 23 nt, Artificial Sequence
  source: /note="Description of Artificial Sequence: Synthetic oligonucleotide"
aaucgaaccacuucacugaucag

SEQ ID NO: 221 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accgagtuuccauaccagaggag

SEQ ID NO: 222 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuagctugaccaaggacucugu

SEQ ID NO: 223 - RNA, 23 nt, Artificial Sequence
  source: /note="Description of Artificial Sequence: Synthetic oligonucleotide"
agccaaaaggcuuagguugaacu

SEQ ID NO: 224 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acacuctccguaguucugucagc

SEQ ID NO: 225 - RNA, 23 nt, Artificial Sequence
  source: /note="Description of Artificial Sequence: Synthetic oligonucleotide"
augugacaagcacacauggaggg

SEQ ID NO: 226 - RNA, 23 nt, Artificial Sequence
  source: /note="Description of Artificial Sequence: Synthetic oligonucleotide"
auuucaaacuggguacguucggu

SEQ ID NO: 227 - RNA, 23 nt, Artificial Sequence
  source: /note="Description of Artificial Sequence: Synthetic oligonucleotide"
aagacugguaugaugugguauca

SEQ ID NO: 228 - RNA, 23 nt, Artificial Sequence
  source: /note="Description of Artificial Sequence: Synthetic oligonucleotide"
aauaaacuuugucacaugcagca

SEQ ID NO: 229 - RNA, 23 nt, Artificial Sequence
  source: /note="Description of Artificial Sequence: Synthetic oligonucleotide"
gaaacugcgaacaggagugaaua

SEQ ID NO: 230 - RNA, 23 nt, Artificial Sequence
  source: /note="Description of Artificial Sequence: Synthetic oligonucleotide"
augguaacagagaagggacagga

SEQ ID NO: 231 - RNA, 23 nt, Artificial Sequence
  source: /note="Description of Artificial Sequence: Synthetic oligonucleotide"
aaauugagucccauucucagaug

SEQ ID NO: 232 - RNA, 23 nt, Artificial Sequence
  source: /note="Description of Artificial Sequence: Synthetic oligonucleotide"
aaugaggaucucaucuucugaag

SEQ ID NO: 233 - RNA, 23 nt, Artificial Sequence
  source: /note="Description of Artificial Sequence: Synthetic oligonucleotide"
aguaucgagagccuucaguggcu

SEQ ID NO: 234 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauagctacaaucacagacucgc

SEQ ID NO: 235 - RNA, 23 nt, Artificial Sequence
  source: /note="Description of Artificial Sequence: Synthetic oligonucleotide"
aucauggaucaaaugccaugaca

SEQ ID NO: 236 - RNA, 23 nt, Artificial Sequence
  source: /note="Description of Artificial Sequence: Synthetic oligonucleotide"
acaacacauagaggaugccgugc

SEQ ID NO: 237 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agccautagcaaucucgcucaug

SEQ ID NO: 238 - RNA, 23 nt, Artificial Sequence
  source: /note="Description of Artificial Sequence: Synthetic oligonucleotide"
aucuccguaguucugucagcguc

SEQ ID NO: 239 - RNA, 23 nt, Artificial Sequence
  source: /note="Description of Artificial Sequence: Synthetic oligonucleotide"
auuggaguaugugaccugcuuuc

SEQ ID NO: 240 - RNA, 23 nt, Artificial Sequence
  source: /note="Description of Artificial Sequence: Synthetic oligonucleotide"
aagauagucacuaacaacuggaa

SEQ ID NO: 241 - RNA, 23 nt, Artificial Sequence
  source: /note="Description of Artificial Sequence: Synthetic oligonucleotide"
aagaucgaaccacuucacugauc

SEQ ID NO: 242 - RNA, 23 nt, Artificial Sequence
  source: /note="Description of Artificial Sequence: Synthetic oligonucleotide"
agaucgaaccacuucacugauca

SEQ ID NO: 243 - RNA, 23 nt, Artificial Sequence
  source: /note="Description of Artificial Sequence: Synthetic oligonucleotide"
aagugugacaagcacacauggag

SEQ ID NO: 244 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuguatcacagaugcugaaaau

SEQ ID NO: 245 - RNA, 23 nt, Artificial Sequence
  source: /note="Description of Artificial Sequence: Synthetic oligonucleotide"
aaaucugguaucgagagccuuca

SEQ ID NO: 246 - RNA, 23 nt, Artificial Sequence
  source: /note="Description of Artificial Sequence: Synthetic oligonucleotide"
aagguggaaagaagucaucuagg

SEQ ID NO: 247 - RNA, 23 nt, Artificial Sequence
  source: /note="Description of Artificial Sequence: Synthetic oligonucleotide"
aacacgaguauagcuguuaacua

SEQ ID NO: 248 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcuautccuuugagguuggaca

SEQ ID NO: 249 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacucutuuggccauuagcaauc

SEQ ID NO: 250 - RNA, 23 nt, Artificial Sequence
  source: /note="Description of Artificial Sequence: Synthetic oligonucleotide"
uccuuugagguuggacagcagau

SEQ ID NO: 251 - RNA, 23 nt, Artificial Sequence
  source: /note="Description of Artificial Sequence: Synthetic oligonucleotide"
uuucaaacuggguacguucggug

SEQ ID NO: 252 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuguataucugagucuacuucc

SEQ ID NO: 253 - RNA, 23 nt, Artificial Sequence
  source: /note="Description of Artificial Sequence: Synthetic oligonucleotide"
ucacuaacaacuggaaugagcug

SEQ ID NO: 254 - RNA, 23 nt, Artificial Sequence
  source: /note="Description of Artificial Sequence: Synthetic oligonucleotide"
agagaucgaaccacuucacugau

SEQ ID NO: 255 - RNA, 23 nt, Artificial Sequence
  source: /note="Description of Artificial Sequence: Synthetic oligonucleotide"
auuuuggccauuagcaaucucgc

SEQ ID NO: 256 - RNA, 23 nt, Artificial Sequence
  source: /note="Description of Artificial Sequence: Synthetic oligonucleotide"
acuuagcuugaccaaggacucug

SEQ ID NO: 257 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaaatcugguaucgagagccu

SEQ ID NO: 258 - RNA, 23 nt, Artificial Sequence
  source: /note="Description of Artificial Sequence: Synthetic oligonucleotide"
uuccauaaacuuugucacaugca

SEQ ID NO: 259 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgagutuccauaccagaggagg

SEQ ID NO: 260 - RNA, 23 nt, Artificial Sequence
  source: /note="Description of Artificial Sequence: Synthetic oligonucleotide"
ugggcuauuccuuugagguugga

SEQ ID NO: 261 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacuctuuuggccauuagcaau

SEQ ID NO: 262 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacacutuacacgggcauaggaa

SEQ ID NO: 263 - RNA, 23 nt, Artificial Sequence
  source: /note="Description of Artificial Sequence: Synthetic oligonucleotide"
auccguaguucugucagcgucag

SEQ ID NO: 264 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaggutuuguauaucugagucu

SEQ ID NO: 265 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacauctugagguggaaagaagu

SEQ ID NO: 266 - RNA, 23 nt, Artificial Sequence
  source: /note="Description of Artificial Sequence: Synthetic oligonucleotide"
acuacaaucacagacucgcuguc

SEQ ID NO: 267 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agguuutguauaucugagucuac

SEQ ID NO: 268 - RNA, 23 nt, Artificial Sequence
  source: /note="Description of Artificial Sequence: Synthetic oligonucleotide"
ucucagaugcuagacucacaaag

SEQ ID NO: 269 - RNA, 23 nt, Artificial Sequence
  source: /note="Description of Artificial Sequence: Synthetic oligonucleotide"
acgaacaggagugaauaucaacc

SEQ ID NO: 270 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accgactagacugaguagcuaca

SEQ ID NO: 271 - RNA, 23 nt, Artificial Sequence
  source: /note="Description of Artificial Sequence: Synthetic oligonucleotide"
agaauugacuggagacacaggug

SEQ ID NO: 272 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaacatagugcauguucccugc

SEQ ID NO: 273 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaggutguacugcaauggcuuc

SEQ ID NO: 274 - RNA, 23 nt, Artificial Sequence
  source: /note="Description of Artificial Sequence: Synthetic oligonucleotide"
uguuugguagggaaccuugcauc

SEQ ID NO: 275 - RNA, 23 nt, Artificial Sequence
  source: /note="Description of Artificial Sequence: Synthetic oligonucleotide"
agcauuacuccacacaucuguau

SEQ ID NO: 276 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaactuugucacaugcagcac

SEQ ID NO: 277 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacuutgucacaugcagcacag

SEQ ID NO: 278 - RNA, 23 nt, Artificial Sequence
  source: /note="Description of Artificial Sequence: Synthetic oligonucleotide"
acauaaacuuugucacaugcagc

SEQ ID NO: 279 - RNA, 23 nt, Artificial Sequence
  source: /note="Description of Artificial Sequence: Synthetic oligonucleotide"
acacgaguauagcuguuaacuag

SEQ ID NO: 280 - RNA, 23 nt, Artificial Sequence
  source: /note="Description of Artificial Sequence: Synthetic oligonucleotide"
agcuuagguugaacuccgagcuc

SEQ ID NO: 281 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaccactucacugaucaggauga

SEQ ID NO: 282 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagactcacaaagcugacugua

SEQ ID NO: 283 - RNA, 23 nt, Artificial Sequence
  source: /note="Description of Artificial Sequence: Synthetic oligonucleotide"
augcgaacaggagugaauaucaa

SEQ ID NO: 284 - RNA, 23 nt, Artificial Sequence
  source: /note="Description of Artificial Sequence: Synthetic oligonucleotide"
aagacuaggagagugcaucaaca

SEQ ID NO: 285 - RNA, 23 nt, Artificial Sequence
  source: /note="Description of Artificial Sequence: Synthetic oligonucleotide"
aacugagguuuuguauaucugag

SEQ ID NO: 286 - RNA, 23 nt, Artificial Sequence
  source: /note="Description of Artificial Sequence: Synthetic oligonucleotide"
uuagcaaucucgcucaugccaag

SEQ ID NO: 287 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaggtucacauccaccuguuc

SEQ ID NO: 288 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuaggtugaacuccgagcucau

SEQ ID NO: 289 - RNA, 23 nt, Artificial Sequence
  source: /note="Description of Artificial Sequence: Synthetic oligonucleotide"
ugcagaagauacaaagggacaga

SEQ ID NO: 290 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacatcuaccaugaggaguaa

SEQ ID NO: 291 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaauctgguaucgagagccuuc

SEQ ID NO: 292 - RNA, 23 nt, Artificial Sequence
  source: /note="Description of Artificial Sequence: Synthetic oligonucleotide"
aggcuuagguugaacuccgagcu

SEQ ID NO: 293 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucctuugagguuggacagca

SEQ ID NO: 294 - RNA, 23 nt, Artificial Sequence
  source: /note="Description of Artificial Sequence: Synthetic oligonucleotide"
aaaauugagucccauucucagau

SEQ ID NO: 295 - RNA, 23 nt, Artificial Sequence
  source: /note="Description of Artificial Sequence: Synthetic oligonucleotide"
acuucacugaucaggaugacggg

SEQ ID NO: 296 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauagctcagagacaccuuuggg

SEQ ID NO: 297 - RNA, 23 nt, Artificial Sequence
  source: /note="Description of Artificial Sequence: Synthetic oligonucleotide"
ugauaagagcaccuguaguagcu

SEQ ID NO: 298 - RNA, 23 nt, Artificial Sequence
  source: /note="Description of Artificial Sequence: Synthetic oligonucleotide"
auuagcaaucucgcucaugccaa

SEQ ID NO: 299 - RNA, 23 nt, Artificial Sequence
  source: /note="Description of Artificial Sequence: Synthetic oligonucleotide"
aauugcaaagcacuccugccauu

SEQ ID NO: 300 - RNA, 23 nt, Artificial Sequence
  source: /note="Description of Artificial Sequence: Synthetic oligonucleotide"
ucuuccaaaucugguaucgagag

SEQ ID NO: 301 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgagtauagcuguuaacuagg

SEQ ID NO: 302 - RNA, 23 nt, Artificial Sequence
  source: /note="Description of Artificial Sequence: Synthetic oligonucleotide"
uaugaacaucuaccaugaggagu

SEQ ID NO: 303 - RNA, 23 nt, Artificial Sequence
  source: /note="Description of Artificial Sequence: Synthetic oligonucleotide"
aaacugcgaacaggagugaauau

SEQ ID NO: 304 - RNA, 23 nt, Artificial Sequence
  source: /note="Description of Artificial Sequence: Synthetic oligonucleotide"
ugacugagguuuuguauaucuga

SEQ ID NO: 305 - RNA, 23 nt, Artificial Sequence
  source: /note="Description of Artificial Sequence: Synthetic oligonucleotide"
accaaaaggcuuagguugaacuc

SEQ ID NO: 306 - RNA, 23 nt, Artificial Sequence
  source: /note="Description of Artificial Sequence: Synthetic oligonucleotide"
acucuccguaguucugucagcgu

SEQ ID NO: 307 - RNA, 23 nt, Artificial Sequence
  source: /note="Description of Artificial Sequence: Synthetic oligonucleotide"
uccugaaggguacaugugcagac

SEQ ID NO: 308 - RNA, 23 nt, Artificial Sequence
  source: /note="Description of Artificial Sequence: Synthetic oligonucleotide"
acacuucacugaucaggaugacg

SEQ ID NO: 309 - RNA, 23 nt, Artificial Sequence
  source: /note="Description of Artificial Sequence: Synthetic oligonucleotide"
aauuagcaaucucgcucaugcca

SEQ ID NO: 310 - RNA, 23 nt, Artificial Sequence
  source: /note="Description of Artificial Sequence: Synthetic oligonucleotide"
aaacauagugcauguucccugca

SEQ ID NO: 311 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugaatacgagaaagaacaaua

SEQ ID NO: 312 - RNA, 23 nt, Artificial Sequence
  source: /note="Description of Artificial Sequence: Synthetic oligonucleotide"
ugaauagcauucuuaucugcacg

SEQ ID NO: 313 - RNA, 23 nt, Artificial Sequence
  source: /note="Description of Artificial Sequence: Synthetic oligonucleotide"
agaggaacuuuauagaguuugcu

SEQ ID NO: 314 - RNA, 23 nt, Artificial Sequence
  source: /note="Description of Artificial Sequence: Synthetic oligonucleotide"
uacgagaaagaacaauaucuuca

SEQ ID NO: 315 - RNA, 23 nt, Artificial Sequence
  source: /note="Description of Artificial Sequence: Synthetic oligonucleotide"
aucaugcaugagaaguuucaggu

SEQ ID NO: 316 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugautaugaauagcauucuua

SEQ ID NO: 317 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcuutgauaacuuuguugagg

SEQ ID NO: 318 - RNA, 23 nt, Artificial Sequence
  source: /note="Description of Artificial Sequence: Synthetic oligonucleotide"
uguaugauguaacgucaguucau

SEQ ID NO: 319 - RNA, 23 nt, Artificial Sequence
  source: /note="Description of Artificial Sequence: Synthetic oligonucleotide"
agacuaaagcaggauuucaggua

SEQ ID NO: 320 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacatauugucagacaaugau

SEQ ID NO: 321 - RNA, 23 nt, Artificial Sequence
  source: /note="Description of Artificial Sequence: Synthetic oligonucleotide"
ucuucaaacugaguacgacuggu

SEQ ID NO: 322 - RNA, 23 nt, Artificial Sequence
  source: /note="Description of Artificial Sequence: Synthetic oligonucleotide"
acccgacuagacugaguagcuac

SEQ ID NO: 323 - RNA, 23 nt, Artificial Sequence
  source: /note="Description of Artificial Sequence: Synthetic oligonucleotide"
uuuuauaacaagagguucaaaca

SEQ ID NO: 324 - RNA, 23 nt, Artificial Sequence
  source: /note="Description of Artificial Sequence: Synthetic oligonucleotide"
uuuauaacaagagguucaaacaa

SEQ ID NO: 325 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaugatcgauguaguucaagau

SEQ ID NO: 326 - RNA, 23 nt, Artificial Sequence
  source: /note="Description of Artificial Sequence: Synthetic oligonucleotide"
uccugaauacgagaaagaacaau

SEQ ID NO: 327 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucagatugucuagaagcugcac

SEQ ID NO: 328 - RNA, 23 nt, Artificial Sequence
  source: /note="Description of Artificial Sequence: Synthetic oligonucleotide"
uuauaacaagagguucaaacaaa

SEQ ID NO: 329 - RNA, 23 nt, Artificial Sequence
  source: /note="Description of Artificial Sequence: Synthetic oligonucleotide"
aguuggaguugaaagguuuucac

SEQ ID NO: 330 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguguatgauguaacgucaguuc

SEQ ID NO: 331 - RNA, 23 nt, Artificial Sequence
  source: /note="Description of Artificial Sequence: Synthetic oligonucleotide"
uugguucucgacuaaagcaggau

SEQ ID NO: 332 - RNA, 23 nt, Artificial Sequence
  source: /note="Description of Artificial Sequence: Synthetic oligonucleotide"
uaaacaccugaucugaauccaga

SEQ ID NO: 333 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuucgtaaacaagucagcagcc

SEQ ID NO: 334 - RNA, 23 nt, Artificial Sequence
  source: /note="Description of Artificial Sequence: Synthetic oligonucleotide"
uaggagagugcaucaacaccagg

SEQ ID NO: 335 - RNA, 23 nt, Artificial Sequence
  source: /note="Description of Artificial Sequence: Synthetic oligonucleotide"
uuuaggaauuccaaugaucuguu

SEQ ID NO: 336 - RNA, 23 nt, Artificial Sequence
  source: /note="Description of Artificial Sequence: Synthetic oligonucleotide"
auccugaauacgagaaagaacaa

SEQ ID NO: 337 - RNA, 23 nt, Artificial Sequence
  source: /note="Description of Artificial Sequence: Synthetic oligonucleotide"
auaucagauugucuagaagcugc

SEQ ID NO: 338 - RNA, 23 nt, Artificial Sequence
  source: /note="Description of Artificial Sequence: Synthetic oligonucleotide"
uguaauagaaaccuugaaaaugu

SEQ ID NO: 339 - RNA, 23 nt, Artificial Sequence
  source: /note="Description of Artificial Sequence: Synthetic oligonucleotide"
agguaucagauugucuagaagcu

SEQ ID NO: 340 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucgugtacuguuuuaaagcuuu

SEQ ID NO: 341 - RNA, 23 nt, Artificial Sequence
  source: /note="Description of Artificial Sequence: Synthetic oligonucleotide"
aagauuagaauccaucaaagcuu

SEQ ID NO: 342 - RNA, 23 nt, Artificial Sequence
  source: /note="Description of Artificial Sequence: Synthetic oligonucleotide"
auguguaugauguaacgucaguu

SEQ ID NO: 343 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuggutcucgacuaaagcagga

SEQ ID NO: 344 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugugutuggagugacgaacaua

SEQ ID NO: 345 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacautucguaaacaagucagc

SEQ ID NO: 346 - RNA, 23 nt, Artificial Sequence
  source: /note="Description of Artificial Sequence: Synthetic oligonucleotide"
acuaggagagugcaucaacacca

SEQ ID NO: 347 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccutggaagauuagaaucca

SEQ ID NO: 348 - RNA, 23 nt, Artificial Sequence
  source: /note="Description of Artificial Sequence: Synthetic oligonucleotide"
uugaaagguuuucacaacgagac

SEQ ID NO: 349 - RNA, 23 nt, Artificial Sequence
  source: /note="Description of Artificial Sequence: Synthetic oligonucleotide"
ugagguaucagauugucuagaag

SEQ ID NO: 350 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagcutugauaacuuuguugag

SEQ ID NO: 351 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuugtuguaacaggaccugag

SEQ ID NO: 352 - RNA, 23 nt, Artificial Sequence
  source: /note="Description of Artificial Sequence: Synthetic oligonucleotide"
auaauuaacccguaacugaacca

SEQ ID NO: 353 - RNA, 23 nt, Artificial Sequence
  source: /note="Description of Artificial Sequence: Synthetic oligonucleotide"
auucaaacugaguacgacugguc

SEQ ID NO: 354 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accguctaacacaauuucagaac

SEQ ID NO: 355 - RNA, 23 nt, Artificial Sequence
  source: /note="Description of Artificial Sequence: Synthetic oligonucleotide"
uguugaacacaaacaguugccau

SEQ ID NO: 356 - RNA, 23 nt, Artificial Sequence
  source: /note="Description of Artificial Sequence: Synthetic oligonucleotide"
aauuguguuuggagugacgaaca

SEQ ID NO: 357 - RNA, 23 nt, Artificial Sequence
  source: /note="Description of Artificial Sequence: Synthetic oligonucleotide"
aauguacaacggaaaugucagcg

SEQ ID NO: 358 - RNA, 23 nt, Artificial Sequence
  source: /note="Description of Artificial Sequence: Synthetic oligonucleotide"
auaaagggcacuuggcaguggcu

SEQ ID NO: 359 - RNA, 23 nt, Artificial Sequence
  source: /note="Description of Artificial Sequence: Synthetic oligonucleotide"
uaacgucaguucauaaaccugga

SEQ ID NO: 360 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaacctuggaagauuagaaucc

SEQ ID NO: 361 - RNA, 23 nt, Artificial Sequence
  source: /note="Description of Artificial Sequence: Synthetic oligonucleotide"
acagugaugaggauuuacuuguu

SEQ ID NO: 362 - RNA, 23 nt, Artificial Sequence
  source: /note="Description of Artificial Sequence: Synthetic oligonucleotide"
uggaagauuagaauccaucaaag

SEQ ID NO: 363 - RNA, 23 nt, Artificial Sequence
  source: /note="Description of Artificial Sequence: Synthetic oligonucleotide"
aaugcaguuugagguaugaagga

SEQ ID NO: 364 - RNA, 23 nt, Artificial Sequence
  source: /note="Description of Artificial Sequence: Synthetic oligonucleotide"
uguuucaauacaaagccaauaaa

SEQ ID NO: 365 - RNA, 23 nt, Artificial Sequence
  source: /note="Description of Artificial Sequence: Synthetic oligonucleotide"
aauuucguaaacaagucagcagc

SEQ ID NO: 366 - RNA, 23 nt, Artificial Sequence
  source: /note="Description of Artificial Sequence: Synthetic oligonucleotide"
uaccgucuaacacaauuucagaa

SEQ ID NO: 367 - RNA, 23 nt, Artificial Sequence
  source: /note="Description of Artificial Sequence: Synthetic oligonucleotide"
acaaacgaaugugauuaugaaua

SEQ ID NO: 368 - RNA, 23 nt, Artificial Sequence
  source: /note="Description of Artificial Sequence: Synthetic oligonucleotide"
uuucacaacgagacugaauugcc

SEQ ID NO: 369 - RNA, 23 nt, Artificial Sequence
  source: /note="Description of Artificial Sequence: Synthetic oligonucleotide"
aacgucaguucauaaaccuggac

SEQ ID NO: 370 - RNA, 23 nt, Artificial Sequence
  source: /note="Description of Artificial Sequence: Synthetic oligonucleotide"
acacauaccaaucccuggaggac

SEQ ID NO: 371 - RNA, 23 nt, Artificial Sequence
  source: /note="Description of Artificial Sequence: Synthetic oligonucleotide"
uuauagaguuugcugaagaaaga

SEQ ID NO: 372 - RNA, 23 nt, Artificial Sequence
  source: /note="Description of Artificial Sequence: Synthetic oligonucleotide"
aaagccauaauuuugggaacagc

SEQ ID NO: 373 - RNA, 23 nt, Artificial Sequence
  source: /note="Description of Artificial Sequence: Synthetic oligonucleotide"
uaugaaggaagaugauagaaacu

SEQ ID NO: 374 - RNA, 23 nt, Artificial Sequence
  source: /note="Description of Artificial Sequence: Synthetic oligonucleotide"
agguagaugaacuccuuaaagac

SEQ ID NO: 375 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaautguugaacacaaacagu

SEQ ID NO: 376 - RNA, 23 nt, Artificial Sequence
  source: /note="Description of Artificial Sequence: Synthetic oligonucleotide"
agauauccacaguugaacagugc

SEQ ID NO: 377 - RNA, 23 nt, Artificial Sequence
  source: /note="Description of Artificial Sequence: Synthetic oligonucleotide"
agcauagaaagaguuacguuaaa

SEQ ID NO: 378 - RNA, 23 nt, Artificial Sequence
  source: /note="Description of Artificial Sequence: Synthetic oligonucleotide"
aaauaggaacuguuccucagagu

SEQ ID NO: 379 - RNA, 23 nt, Artificial Sequence
  source: /note="Description of Artificial Sequence: Synthetic oligonucleotide"
aacaaacgaaugugauuaugaau

SEQ ID NO: 380 - RNA, 23 nt, Artificial Sequence
  source: /note="Description of Artificial Sequence: Synthetic oligonucleotide"
acuuggaagauuagaauccauca

SEQ ID NO: 381 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaugatguaacgucaguucaua

SEQ ID NO: 382 - RNA, 23 nt, Artificial Sequence
  source: /note="Description of Artificial Sequence: Synthetic oligonucleotide"
ugucaagaggaacuuuauagagu

SEQ ID NO: 383 - RNA, 23 nt, Artificial Sequence
  source: /note="Description of Artificial Sequence: Synthetic oligonucleotide"
acgaaugugauuaugaauagcau

SEQ ID NO: 384 - RNA, 23 nt, Artificial Sequence
  source: /note="Description of Artificial Sequence: Synthetic oligonucleotide"
acuaagagcacauuuaguagcca

SEQ ID NO: 385 - RNA, 23 nt, Artificial Sequence
  source: /note="Description of Artificial Sequence: Synthetic oligonucleotide"
agucguguacuguuuuaaagcuu

SEQ ID NO: 386 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaacgtcaguucauaaaccugg

SEQ ID NO: 387 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaguctucaacaauuguugaac

SEQ ID NO: 388 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcaatagaaaguauguugcug

SEQ ID NO: 389 - RNA, 23 nt, Artificial Sequence
  source: /note="Description of Artificial Sequence: Synthetic oligonucleotide"
aggaacauguacaacggaaaugu

SEQ ID NO: 390 - RNA, 23 nt, Artificial Sequence
  source: /note="Description of Artificial Sequence: Synthetic oligonucleotide"
augguuauugugcugacggagaa

SEQ ID NO: 391 - RNA, 23 nt, Artificial Sequence
  source: /note="Description of Artificial Sequence: Synthetic oligonucleotide"
aauuaacccguaacugaaccagc

SEQ ID NO: 392 - RNA, 23 nt, Artificial Sequence
  source: /note="Description of Artificial Sequence: Synthetic oligonucleotide"
uguaaccuuggaagauuagaauc

SEQ ID NO: 393 - RNA, 23 nt, Artificial Sequence
  source: /note="Description of Artificial Sequence: Synthetic oligonucleotide"
acuauaaguuccacaauacuccc

SEQ ID NO: 394 - RNA, 23 nt, Artificial Sequence
  source: /note="Description of Artificial Sequence: Synthetic oligonucleotide"
aauacgagaaagaacaauaucuu

SEQ ID NO: 395 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augaggtaucagauugucuagaa

SEQ ID NO: 396 - RNA, 23 nt, Artificial Sequence
  source: /note="Description of Artificial Sequence: Synthetic oligonucleotide"
aaacgaagcagauaaaaggcgga

SEQ ID NO: 397 - RNA, 23 nt, Artificial Sequence
  source: /note="Description of Artificial Sequence: Synthetic oligonucleotide"
uuuugaaugauagcguucauaag

SEQ ID NO: 398 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaccgtcuaacacaauuucaga

SEQ ID NO: 399 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacautccagacuugaagaugu

SEQ ID NO: 400 - RNA, 23 nt, Artificial Sequence
  source: /note="Description of Artificial Sequence: Synthetic oligonucleotide"
aacaggaacauguacaacggaaa

SEQ ID NO: 401 - RNA, 23 nt, Artificial Sequence
  source: /note="Description of Artificial Sequence: Synthetic oligonucleotide"
aguaucagauugucuagaagcug

SEQ ID NO: 402 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguaautaacccguaacugaacc

SEQ ID NO: 403 - RNA, 23 nt, Artificial Sequence
  source: /note="Description of Artificial Sequence: Synthetic oligonucleotide"
agacuaagugagucuugcauggu

SEQ ID NO: 404 - RNA, 23 nt, Artificial Sequence
  source: /note="Description of Artificial Sequence: Synthetic oligonucleotide"
agaucucgauucagagucauccu

SEQ ID NO: 405 - RNA, 23 nt, Artificial Sequence
  source: /note="Description of Artificial Sequence: Synthetic oligonucleotide"
auugguaguagguuauagccucu

SEQ ID NO: 406 - RNA, 23 nt, Artificial Sequence
  source: /note="Description of Artificial Sequence: Synthetic oligonucleotide"
aauccgaucucgauucagaguca

SEQ ID NO: 407 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguuatgcuugguaguagguua

SEQ ID NO: 408 - RNA, 23 nt, Artificial Sequence
  source: /note="Description of Artificial Sequence: Synthetic oligonucleotide"
aacauccgaucucgauucagagu

SEQ ID NO: 409 - RNA, 23 nt, Artificial Sequence
  source: /note="Description of Artificial Sequence: Synthetic oligonucleotide"
uuacuuguuguaacaggaccuga

SEQ ID NO: 410 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaauutaucaacacugcuguca

SEQ ID NO: 411 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuacutguuguaacaggaccug

SEQ ID NO: 412 - RNA, 23 nt, Artificial Sequence
  source: /note="Description of Artificial Sequence: Synthetic oligonucleotide"
uccaugaucgauguaguucaaga

SEQ ID NO: 413 - RNA, 23 nt, Artificial Sequence
  source: /note="Description of Artificial Sequence: Synthetic oligonucleotide"
agcuuagguugaacuccgaguuc

SEQ ID NO: 414 - RNA, 23 nt, Artificial Sequence
  source: /note="Description of Artificial Sequence: Synthetic oligonucleotide"
aauaggaacuguuccucagaguc

SEQ ID NO: 415 - RNA, 23 nt, Artificial Sequence
  source: /note="Description of Artificial Sequence: Synthetic oligonucleotide"
aggcuuagguugaacuccgaguu

SEQ ID NO: 416 - RNA, 23 nt, Artificial Sequence
  source: /note="Description of Artificial Sequence: Synthetic oligonucleotide"
acaauaggaacuguuccucagag

SEQ ID NO: 417 - RNA, 23 nt, Artificial Sequence
  source: /note="Description of Artificial Sequence: Synthetic oligonucleotide"
uuaaaagcccuguauaaugauga

SEQ ID NO: 418 - RNA, 21 nt, Artificial Sequence
  source: /note="Description of Artificial Sequence: Synthetic oligonucleotide"
ggacuaaaacuuuuuaucaaa

SEQ ID NO: 419 - RNA, 21 nt, Artificial Sequence
  source: /note="Description of Artificial Sequence: Synthetic oligonucleotide"
cucuguuaccagcuacuacau

SEQ ID NO: 420 - RNA, 21 nt, Artificial Sequence
  source: /note="Description of Artificial Sequence: Synthetic oligonucleotide"
ccugucccuucucuguuacca

SEQ ID NO: 421 - RNA, 21 nt, Artificial Sequence
  source: /note="Description of Artificial Sequence: Synthetic oligonucleotide"
uuugugagucuagcaucugau

SEQ ID NO: 422 - RNA, 21 nt, Artificial Sequence
  source: /note="Description of Artificial Sequence: Synthetic oligonucleotide"
gaucagugaagugguucgauu

SEQ ID NO: 423 - RNA, 21 nt, Artificial Sequence
  source: /note="Description of Artificial Sequence: Synthetic oligonucleotide"
ccucugguauggaaacucggu

SEQ ID NO: 424 - RNA, 21 nt, Artificial Sequence
  source: /note="Description of Artificial Sequence: Synthetic oligonucleotide"
agaguccuuggucaagcuaau

SEQ ID NO: 425 - RNA, 21 nt, Artificial Sequence
  source: /note="Description of Artificial Sequence: Synthetic oligonucleotide"
uucaaccuaagccuuuuggcu

SEQ ID NO: 426 - RNA, 21 nt, Artificial Sequence
  source: /note="Description of Artificial Sequence: Synthetic oligonucleotide"
ugacagaacuacggagagugu

SEQ ID NO: 427 - RNA, 21 nt, Artificial Sequence
  source: /note="Description of Artificial Sequence: Synthetic oligonucleotide"
cuccaugugugcuugucacau

SEQ ID NO: 428 - RNA, 21 nt, Artificial Sequence
  source: /note="Description of Artificial Sequence: Synthetic oligonucleotide"
cgaacguacccaguuugaaau

SEQ ID NO: 429 - RNA, 21 nt, Artificial Sequence
  source: /note="Description of Artificial Sequence: Synthetic oligonucleotide"
auaccacaucauaccagucuu

SEQ ID NO: 430 - RNA, 21 nt, Artificial Sequence
  source: /note="Description of Artificial Sequence: Synthetic oligonucleotide"
cugcaugugacaaaguuuauu

SEQ ID NO: 431 - RNA, 21 nt, Artificial Sequence
  source: /note="Description of Artificial Sequence: Synthetic oligonucleotide"
uucacuccuguucgcaguuuc

SEQ ID NO: 432 - RNA, 21 nt, Artificial Sequence
  source: /note="Description of Artificial Sequence: Synthetic oligonucleotide"
cugucccuucucuguuaccau

SEQ ID NO: 433 - RNA, 21 nt, Artificial Sequence
  source: /note="Description of Artificial Sequence: Synthetic oligonucleotide"
ucugagaaugggacucaauuu

SEQ ID NO: 434 - RNA, 21 nt, Artificial Sequence
  source: /note="Description of Artificial Sequence: Synthetic oligonucleotide"
ucagaagaugagauccucauu

SEQ ID NO: 435 - RNA, 21 nt, Artificial Sequence
  source: /note="Description of Artificial Sequence: Synthetic oligonucleotide"
ccacugaaggcucucgauacu

SEQ ID NO: 436 - RNA, 21 nt, Artificial Sequence
  source: /note="Description of Artificial Sequence: Synthetic oligonucleotide"
gagucugugauuguagcuauu

SEQ ID NO: 437 - RNA, 21 nt, Artificial Sequence
  source: /note="Description of Artificial Sequence: Synthetic oligonucleotide"
ucauggcauuugauccaugau

SEQ ID NO: 438 - RNA, 21 nt, Artificial Sequence
  source: /note="Description of Artificial Sequence: Synthetic oligonucleotide"
acggcauccucuauguguugu

SEQ ID NO: 439 - RNA, 21 nt, Artificial Sequence
  source: /note="Description of Artificial Sequence: Synthetic oligonucleotide"
ugagcgagauugcuaauggcu

SEQ ID NO: 440 - RNA, 21 nt, Artificial Sequence
  source: /note="Description of Artificial Sequence: Synthetic oligonucleotide"
cgcugacagaacuacggagau

SEQ ID NO: 441 - RNA, 21 nt, Artificial Sequence
  source: /note="Description of Artificial Sequence: Synthetic oligonucleotide"
aagcaggucacauacuccaau

SEQ ID NO: 442 - RNA, 21 nt, Artificial Sequence
  source: /note="Description of Artificial Sequence: Synthetic oligonucleotide"
ccaguuguuagugacuaucuu

SEQ ID NO: 443 - RNA, 21 nt, Artificial Sequence
  source: /note="Description of Artificial Sequence: Synthetic oligonucleotide"
ucagugaagugguucgaucuu

SEQ ID NO: 444 - RNA, 21 nt, Artificial Sequence
  source: /note="Description of Artificial Sequence: Synthetic oligonucleotide"
aucagugaagugguucgaucu

SEQ ID NO: 445 - RNA, 21 nt, Artificial Sequence
  source: /note="Description of Artificial Sequence: Synthetic oligonucleotide"
ccaugugugcuugucacacuu

SEQ ID NO: 446 - RNA, 21 nt, Artificial Sequence
  source: /note="Description of Artificial Sequence: Synthetic oligonucleotide"
uuucagcaucugugauacaga

SEQ ID NO: 447 - RNA, 21 nt, Artificial Sequence
  source: /note="Description of Artificial Sequence: Synthetic oligonucleotide"
aaggcucucgauaccagauuu

SEQ ID NO: 448 - RNA, 21 nt, Artificial Sequence
  source: /note="Description of Artificial Sequence: Synthetic oligonucleotide"
uagaugacuucuuuccaccuu

SEQ ID NO: 449 - RNA, 21 nt, Artificial Sequence
  source: /note="Description of Artificial Sequence: Synthetic oligonucleotide"
guuaacagcuauacucguguu

SEQ ID NO: 450 - RNA, 21 nt, Artificial Sequence
  source: /note="Description of Artificial Sequence: Synthetic oligonucleotide"
uccaaccucaaaggaauagcu

SEQ ID NO: 451 - RNA, 21 nt, Artificial Sequence
  source: /note="Description of Artificial Sequence: Synthetic oligonucleotide"
uugcuaauggccaaaagaguu

SEQ ID NO: 452 - RNA, 21 nt, Artificial Sequence
  source: /note="Description of Artificial Sequence: Synthetic oligonucleotide"
cugcuguccaaccucaaagga

SEQ ID NO: 453 - RNA, 21 nt, Artificial Sequence
  source: /note="Description of Artificial Sequence: Synthetic oligonucleotide"
ccgaacguacccaguuugaaa

SEQ ID NO: 454 - RNA, 21 nt, Artificial Sequence
  source: /note="Description of Artificial Sequence: Synthetic oligonucleotide"
aaguagacucagauauacaaa

SEQ ID NO: 455 - RNA, 21 nt, Artificial Sequence
  source: /note="Description of Artificial Sequence: Synthetic oligonucleotide"
gcucauuccaguuguuaguga

SEQ ID NO: 456 - RNA, 21 nt, Artificial Sequence
  source: /note="Description of Artificial Sequence: Synthetic oligonucleotide"
cagugaagugguucgaucucu

SEQ ID NO: 457 - RNA, 21 nt, Artificial Sequence
  source: /note="Description of Artificial Sequence: Synthetic oligonucleotide"
gagauugcuaauggccaaaau

SEQ ID NO: 458 - RNA, 21 nt, Artificial Sequence
  source: /note="Description of Artificial Sequence: Synthetic oligonucleotide"
gaguccuuggucaagcuaagu

SEQ ID NO: 459 - RNA, 21 nt, Artificial Sequence
  source: /note="Description of Artificial Sequence: Synthetic oligonucleotide"
gcucucgauaccagauuugga

SEQ ID NO: 460 - RNA, 21 nt, Artificial Sequence
  source: /note="Description of Artificial Sequence: Synthetic oligonucleotide"
caugugacaaaguuuauggaa

SEQ ID NO: 461 - RNA, 21 nt, Artificial Sequence
  source: /note="Description of Artificial Sequence: Synthetic oligonucleotide"
uccucugguauggaaacucgu

SEQ ID NO: 462 - RNA, 21 nt, Artificial Sequence
  source: /note="Description of Artificial Sequence: Synthetic oligonucleotide"
caaccucaaaggaauagccca

SEQ ID NO: 463 - RNA, 21 nt, Artificial Sequence
  source: /note="Description of Artificial Sequence: Synthetic oligonucleotide"
ugcuaauggccaaaagagucu

SEQ ID NO: 464 - RNA, 21 nt, Artificial Sequence
  source: /note="Description of Artificial Sequence: Synthetic oligonucleotide"
ccuaugcccguguaaaguguu

SEQ ID NO: 465 - RNA, 21 nt, Artificial Sequence
  source: /note="Description of Artificial Sequence: Synthetic oligonucleotide"
gacgcugacagaacuacggau

SEQ ID NO: 466 - RNA, 21 nt, Artificial Sequence
  source: /note="Description of Artificial Sequence: Synthetic oligonucleotide"
acucagauauacaaaaccuca

SEQ ID NO: 467 - RNA, 21 nt, Artificial Sequence
  source: /note="Description of Artificial Sequence: Synthetic oligonucleotide"
uucuuuccaccucaagauguu

SEQ ID NO: 468 - RNA, 21 nt, Artificial Sequence
  source: /note="Description of Artificial Sequence: Synthetic oligonucleotide"
cagcgagucugugauuguagu

SEQ ID NO: 469 - RNA, 21 nt, Artificial Sequence
  source: /note="Description of Artificial Sequence: Synthetic oligonucleotide"
agacucagauauacaaaaccu

SEQ ID NO: 470 - RNA, 21 nt, Artificial Sequence
  source: /note="Description of Artificial Sequence: Synthetic oligonucleotide"
uugugagucuagcaucugaga

SEQ ID NO: 471 - RNA, 21 nt, Artificial Sequence
  source: /note="Description of Artificial Sequence: Synthetic oligonucleotide"
uugauauucacuccuguucgu

SEQ ID NO: 472 - RNA, 21 nt, Artificial Sequence
  source: /note="Description of Artificial Sequence: Synthetic oligonucleotide"
uagcuacucagucuagucggu

SEQ ID NO: 473 - RNA, 21 nt, Artificial Sequence
  source: /note="Description of Artificial Sequence: Synthetic oligonucleotide"
ccugugucuccagucaauucu

SEQ ID NO: 474 - RNA, 21 nt, Artificial Sequence
  source: /note="Description of Artificial Sequence: Synthetic oligonucleotide"
agggaacaugcacuauguugu

SEQ ID NO: 475 - RNA, 21 nt, Artificial Sequence
  source: /note="Description of Artificial Sequence: Synthetic oligonucleotide"
agccauugcaguacaaccugu

SEQ ID NO: 476 - RNA, 21 nt, Artificial Sequence
  source: /note="Description of Artificial Sequence: Synthetic oligonucleotide"
ugcaagguucccuaccaaaca

SEQ ID NO: 477 - RNA, 21 nt, Artificial Sequence
  source: /note="Description of Artificial Sequence: Synthetic oligonucleotide"
acagauguguggaguaaugcu

SEQ ID NO: 478 - RNA, 21 nt, Artificial Sequence
  source: /note="Description of Artificial Sequence: Synthetic oligonucleotide"
gcugcaugugacaaaguuuau

SEQ ID NO: 479 - RNA, 21 nt, Artificial Sequence
  source: /note="Description of Artificial Sequence: Synthetic oligonucleotide"
gugcugcaugugacaaaguuu

SEQ ID NO: 480 - RNA, 21 nt, Artificial Sequence
  source: /note="Description of Artificial Sequence: Synthetic oligonucleotide"
ugcaugugacaaaguuuaugu

SEQ ID NO: 481 - RNA, 21 nt, Artificial Sequence
  source: /note="Description of Artificial Sequence: Synthetic oligonucleotide"
aguuaacagcuauacucgugu

SEQ ID NO: 482 - RNA, 21 nt, Artificial Sequence
  source: /note="Description of Artificial Sequence: Synthetic oligonucleotide"
gcucggaguucaaccuaagcu

SEQ ID NO: 483 - RNA, 21 nt, Artificial Sequence
  source: /note="Description of Artificial Sequence: Synthetic oligonucleotide"
auccugaucagugaagugguu

SEQ ID NO: 484 - RNA, 21 nt, Artificial Sequence
  source: /note="Description of Artificial Sequence: Synthetic oligonucleotide"
cagucagcuuugugagucuau

SEQ ID NO: 485 - RNA, 21 nt, Artificial Sequence
  source: /note="Description of Artificial Sequence: Synthetic oligonucleotide"
gauauucacuccuguucgcau

SEQ ID NO: 486 - RNA, 21 nt, Artificial Sequence
  source: /note="Description of Artificial Sequence: Synthetic oligonucleotide"
uugaugcacucuccuagucuu

SEQ ID NO: 487 - RNA, 21 nt, Artificial Sequence
  source: /note="Description of Artificial Sequence: Synthetic oligonucleotide"
cagauauacaaaaccucaguu

SEQ ID NO: 488 - RNA, 21 nt, Artificial Sequence
  source: /note="Description of Artificial Sequence: Synthetic oligonucleotide"
uggcaugagcgagauugcuaa

SEQ ID NO: 489 - RNA, 21 nt, Artificial Sequence
  source: /note="Description of Artificial Sequence: Synthetic oligonucleotide"
acagguggaugugaaccuuuu

SEQ ID NO: 490 - RNA, 21 nt, Artificial Sequence
  source: /note="Description of Artificial Sequence: Synthetic oligonucleotide"
gagcucggaguucaaccuaau

SEQ ID NO: 491 - RNA, 21 nt, Artificial Sequence
  source: /note="Description of Artificial Sequence: Synthetic oligonucleotide"
ugucccuuuguaucuucugca

SEQ ID NO: 492 - RNA, 21 nt, Artificial Sequence
  source: /note="Description of Artificial Sequence: Synthetic oligonucleotide"
acuccucaugguagauguuca

SEQ ID NO: 493 - RNA, 21 nt, Artificial Sequence
  source: /note="Description of Artificial Sequence: Synthetic oligonucleotide"
aggcucucgauaccagauuug

SEQ ID NO: 494 - RNA, 21 nt, Artificial Sequence
  source: /note="Description of Artificial Sequence: Synthetic oligonucleotide"
cucggaguucaaccuaagccu

SEQ ID NO: 495 - RNA, 21 nt, Artificial Sequence
  source: /note="Description of Artificial Sequence: Synthetic oligonucleotide"
cuguccaaccucaaaggaaua

SEQ ID NO: 496 - RNA, 21 nt, Artificial Sequence
  source: /note="Description of Artificial Sequence: Synthetic oligonucleotide"
cugagaaugggacucaauuuu

SEQ ID NO: 497 - RNA, 21 nt, Artificial Sequence
  source: /note="Description of Artificial Sequence: Synthetic oligonucleotide"
cgucauccugaucagugaagu

SEQ ID NO: 498 - RNA, 21 nt, Artificial Sequence
  source: /note="Description of Artificial Sequence: Synthetic oligonucleotide"
caaaggugucucugagcuauu

SEQ ID NO: 499 - RNA, 21 nt, Artificial Sequence
  source: /note="Description of Artificial Sequence: Synthetic oligonucleotide"
cuacuacaggugcucuuauca

SEQ ID NO: 500 - RNA, 21 nt, Artificial Sequence
  source: /note="Description of Artificial Sequence: Synthetic oligonucleotide"
ggcaugagcgagauugcuaau

SEQ ID NO: 501 - RNA, 21 nt, Artificial Sequence
  source: /note="Description of Artificial Sequence: Synthetic oligonucleotide"
uggcaggagugcuuugcaauu

SEQ ID NO: 502 - RNA, 21 nt, Artificial Sequence
  source: /note="Description of Artificial Sequence: Synthetic oligonucleotide"
cucgauaccagauuuggaaga

SEQ ID NO: 503 - RNA, 21 nt, Artificial Sequence
  source: /note="Description of Artificial Sequence: Synthetic oligonucleotide"
uaguuaacagcuauacucguu

SEQ ID NO: 504 - RNA, 21 nt, Artificial Sequence
  source: /note="Description of Artificial Sequence: Synthetic oligonucleotide"
uccucaugguagauguucaua

SEQ ID NO: 505 - RNA, 21 nt, Artificial Sequence
  source: /note="Description of Artificial Sequence: Synthetic oligonucleotide"
auucacuccuguucgcaguuu

SEQ ID NO: 506 - RNA, 21 nt, Artificial Sequence
  source: /note="Description of Artificial Sequence: Synthetic oligonucleotide"
agauauacaaaaccucaguca

SEQ ID NO: 507 - RNA, 21 nt, Artificial Sequence
  source: /note="Description of Artificial Sequence: Synthetic oligonucleotide"
guucaaccuaagccuuuuggu

SEQ ID NO: 508 - RNA, 21 nt, Artificial Sequence
  source: /note="Description of Artificial Sequence: Synthetic oligonucleotide"
gcugacagaacuacggagagu

SEQ ID NO: 509 - RNA, 21 nt, Artificial Sequence
  source: /note="Description of Artificial Sequence: Synthetic oligonucleotide"
cugcacauguacccuucagga

SEQ ID NO: 510 - RNA, 21 nt, Artificial Sequence
  source: /note="Description of Artificial Sequence: Synthetic oligonucleotide"
ucauccugaucagugaagugu

SEQ ID NO: 511 - RNA, 21 nt, Artificial Sequence
  source: /note="Description of Artificial Sequence: Synthetic oligonucleotide"
gcaugagcgagauugcuaauu

SEQ ID NO: 512 - RNA, 21 nt, Artificial Sequence
  source: /note="Description of Artificial Sequence: Synthetic oligonucleotide"
cagggaacaugcacuauguuu

SEQ ID NO: 513 - RNA, 21 nt, Artificial Sequence
  source: /note="Description of Artificial Sequence: Synthetic oligonucleotide"
uuguucuuucucguauucagu

SEQ ID NO: 514 - RNA, 21 nt, Artificial Sequence
  source: /note="Description of Artificial Sequence: Synthetic oligonucleotide"
ugcagauaagaaugcuauuca

SEQ ID NO: 515 - RNA, 21 nt, Artificial Sequence
  source: /note="Description of Artificial Sequence: Synthetic oligonucleotide"
caaacucuauaaaguuccucu

SEQ ID NO: 516 - RNA, 21 nt, Artificial Sequence
  source: /note="Description of Artificial Sequence: Synthetic oligonucleotide"
aagauauuguucuuucucgua

SEQ ID NO: 517 - RNA, 21 nt, Artificial Sequence
  source: /note="Description of Artificial Sequence: Synthetic oligonucleotide"
cugaaacuucucaugcaugau

SEQ ID NO: 518 - RNA, 21 nt, Artificial Sequence
  source: /note="Description of Artificial Sequence: Synthetic oligonucleotide"
agaaugcuauucauaaucaca

SEQ ID NO: 519 - RNA, 21 nt, Artificial Sequence
  source: /note="Description of Artificial Sequence: Synthetic oligonucleotide"
ucaacaaaguuaucaaagcuu

SEQ ID NO: 520 - RNA, 21 nt, Artificial Sequence
  source: /note="Description of Artificial Sequence: Synthetic oligonucleotide"
gaacugacguuacaucauaca

SEQ ID NO: 521 - RNA, 21 nt, Artificial Sequence
  source: /note="Description of Artificial Sequence: Synthetic oligonucleotide"
ccugaaauccugcuuuagucu

SEQ ID NO: 522 - RNA, 21 nt, Artificial Sequence
  source: /note="Description of Artificial Sequence: Synthetic oligonucleotide"
cauugucugacaauaugugaa

SEQ ID NO: 523 - RNA, 21 nt, Artificial Sequence
  source: /note="Description of Artificial Sequence: Synthetic oligonucleotide"
cagucguacucaguuugaaga

SEQ ID NO: 524 - RNA, 21 nt, Artificial Sequence
  source: /note="Description of Artificial Sequence: Synthetic oligonucleotide"
agcuacucagucuagucgggu

SEQ ID NO: 525 - RNA, 21 nt, Artificial Sequence
  source: /note="Description of Artificial Sequence: Synthetic oligonucleotide"
uuugaaccucuuguuauaaaa

SEQ ID NO: 526 - RNA, 21 nt, Artificial Sequence
  source: /note="Description of Artificial Sequence: Synthetic oligonucleotide"
guuugaaccucuuguuauaaa

SEQ ID NO: 527 - RNA, 21 nt, Artificial Sequence
  source: /note="Description of Artificial Sequence: Synthetic oligonucleotide"
cuugaacuacaucgaucaugu

SEQ ID NO: 528 - RNA, 21 nt, Artificial Sequence
  source: /note="Description of Artificial Sequence: Synthetic oligonucleotide"
uguucuuucucguauucagga

SEQ ID NO: 529 - RNA, 21 nt, Artificial Sequence
  source: /note="Description of Artificial Sequence: Synthetic oligonucleotide"
gcagcuucuagacaaucugau

SEQ ID NO: 530 - RNA, 21 nt, Artificial Sequence
  source: /note="Description of Artificial Sequence: Synthetic oligonucleotide"
uguuugaaccucuuguuauaa

SEQ ID NO: 531 - RNA, 21 nt, Artificial Sequence
  source: /note="Description of Artificial Sequence: Synthetic oligonucleotide"
gaaaaccuuucaacuccaacu

SEQ ID NO: 532 - RNA, 21 nt, Artificial Sequence
  source: /note="Description of Artificial Sequence: Synthetic oligonucleotide"
acugacguuacaucauacaca

SEQ ID NO: 533 - RNA, 21 nt, Artificial Sequence
  source: /note="Description of Artificial Sequence: Synthetic oligonucleotide"
ccugcuuuagucgagaaccaa

SEQ ID NO: 534 - RNA, 21 nt, Artificial Sequence
  source: /note="Description of Artificial Sequence: Synthetic oligonucleotide"
uggauucagaucagguguuua

SEQ ID NO: 535 - RNA, 21 nt, Artificial Sequence
  source: /note="Description of Artificial Sequence: Synthetic oligonucleotide"
cugcugacuuguuuacgaaau

SEQ ID NO: 536 - RNA, 21 nt, Artificial Sequence
  source: /note="Description of Artificial Sequence: Synthetic oligonucleotide"
ugguguugaugcacucuccua

SEQ ID NO: 537 - RNA, 21 nt, Artificial Sequence
  source: /note="Description of Artificial Sequence: Synthetic oligonucleotide"
cagaucauuggaauuccuaaa

SEQ ID NO: 538 - RNA, 21 nt, Artificial Sequence
  source: /note="Description of Artificial Sequence: Synthetic oligonucleotide"
guucuuucucguauucaggau

SEQ ID NO: 539 - RNA, 21 nt, Artificial Sequence
  source: /note="Description of Artificial Sequence: Synthetic oligonucleotide"
agcuucuagacaaucugauau

SEQ ID NO: 540 - RNA, 21 nt, Artificial Sequence
  source: /note="Description of Artificial Sequence: Synthetic oligonucleotide"
auuuucaagguuucuauuaca

SEQ ID NO: 541 - RNA, 21 nt, Artificial Sequence
  source: /note="Description of Artificial Sequence: Synthetic oligonucleotide"
cuucuagacaaucugauaccu

SEQ ID NO: 542 - RNA, 21 nt, Artificial Sequence
  source: /note="Description of Artificial Sequence: Synthetic oligonucleotide"
agcuuuaaaacaguacacgau

SEQ ID NO: 543 - RNA, 21 nt, Artificial Sequence
  source: /note="Description of Artificial Sequence: Synthetic oligonucleotide"
gcuuugauggauucuaaucuu

SEQ ID NO: 544 - RNA, 21 nt, Artificial Sequence
  source: /note="Description of Artificial Sequence: Synthetic oligonucleotide"
cugacguuacaucauacacau

SEQ ID NO: 545 - RNA, 21 nt, Artificial Sequence
  source: /note="Description of Artificial Sequence: Synthetic oligonucleotide"
cugcuuuagucgagaaccaau

SEQ ID NO: 546 - RNA, 21 nt, Artificial Sequence
  source: /note="Description of Artificial Sequence: Synthetic oligonucleotide"
uguucgucacuccaaacacaa

SEQ ID NO: 547 - RNA, 21 nt, Artificial Sequence
  source: /note="Description of Artificial Sequence: Synthetic oligonucleotide"
ugacuuguuuacgaaaugucu

SEQ ID NO: 548 - RNA, 21 nt, Artificial Sequence
  source: /note="Description of Artificial Sequence: Synthetic oligonucleotide"
guguugaugcacucuccuagu

SEQ ID NO: 549 - RNA, 21 nt, Artificial Sequence
  source: /note="Description of Artificial Sequence: Synthetic oligonucleotide"
gauucuaaucuuccaagguua

SEQ ID NO: 550 - RNA, 21 nt, Artificial Sequence
  source: /note="Description of Artificial Sequence: Synthetic oligonucleotide"
cucguugugaaaaccuuucaa

SEQ ID NO: 551 - RNA, 21 nt, Artificial Sequence
  source: /note="Description of Artificial Sequence: Synthetic oligonucleotide"
ucuagacaaucugauaccuca

SEQ ID NO: 552 - RNA, 21 nt, Artificial Sequence
  source: /note="Description of Artificial Sequence: Synthetic oligonucleotide"
caacaaaguuaucaaagcuuu

SEQ ID NO: 553 - RNA, 21 nt, Artificial Sequence
  source: /note="Description of Artificial Sequence: Synthetic oligonucleotide"
cagguccuguuacaacaagua

SEQ ID NO: 554 - RNA, 21 nt, Artificial Sequence
  source: /note="Description of Artificial Sequence: Synthetic oligonucleotide"
guucaguuacggguuaauuau

SEQ ID NO: 555 - RNA, 21 nt, Artificial Sequence
  source: /note="Description of Artificial Sequence: Synthetic oligonucleotide"
ccagucguacucaguuugaau

SEQ ID NO: 556 - RNA, 21 nt, Artificial Sequence
  source: /note="Description of Artificial Sequence: Synthetic oligonucleotide"
ucugaaauuguguuagacggu

SEQ ID NO: 557 - RNA, 21 nt, Artificial Sequence
  source: /note="Description of Artificial Sequence: Synthetic oligonucleotide"
ggcaacuguuuguguucaaca

SEQ ID NO: 558 - RNA, 21 nt, Artificial Sequence
  source: /note="Description of Artificial Sequence: Synthetic oligonucleotide"
uucgucacuccaaacacaauu

SEQ ID NO: 559 - RNA, 21 nt, Artificial Sequence
  source: /note="Description of Artificial Sequence: Synthetic oligonucleotide"
cugacauuuccguuguacauu

SEQ ID NO: 560 - RNA, 21 nt, Artificial Sequence
  source: /note="Description of Artificial Sequence: Synthetic oligonucleotide"
ccacugccaagugcccuuuau

SEQ ID NO: 561 - RNA, 21 nt, Artificial Sequence
  source: /note="Description of Artificial Sequence: Synthetic oligonucleotide"
cagguuuaugaacugacguua

SEQ ID NO: 562 - RNA, 21 nt, Artificial Sequence
  source: /note="Description of Artificial Sequence: Synthetic oligonucleotide"
auucuaaucuuccaagguuau

SEQ ID NO: 563 - RNA, 21 nt, Artificial Sequence
  source: /note="Description of Artificial Sequence: Synthetic oligonucleotide"
caaguaaauccucaucacugu

SEQ ID NO: 564 - RNA, 21 nt, Artificial Sequence
  source: /note="Description of Artificial Sequence: Synthetic oligonucleotide"
uugauggauucuaaucuucca

SEQ ID NO: 565 - RNA, 21 nt, Artificial Sequence
  source: /note="Description of Artificial Sequence: Synthetic oligonucleotide"
cuucauaccucaaacugcauu

SEQ ID NO: 566 - RNA, 21 nt, Artificial Sequence
  source: /note="Description of Artificial Sequence: Synthetic oligonucleotide"
uauuggcuuuguauugaaaca

SEQ ID NO: 567 - RNA, 21 nt, Artificial Sequence
  source: /note="Description of Artificial Sequence: Synthetic oligonucleotide"
ugcugacuuguuuacgaaauu

SEQ ID NO: 568 - RNA, 21 nt, Artificial Sequence
  source: /note="Description of Artificial Sequence: Synthetic oligonucleotide"
cugaaauuguguuagacggua

SEQ ID NO: 569 - RNA, 21 nt, Artificial Sequence
  source: /note="Description of Artificial Sequence: Synthetic oligonucleotide"
uucauaaucacauucguuugu

SEQ ID NO: 570 - RNA, 21 nt, Artificial Sequence
  source: /note="Description of Artificial Sequence: Synthetic oligonucleotide"
caauucagucucguugugaaa

SEQ ID NO: 571 - RNA, 21 nt, Artificial Sequence
  source: /note="Description of Artificial Sequence: Synthetic oligonucleotide"
ccagguuuaugaacugacguu

SEQ ID NO: 572 - RNA, 21 nt, Artificial Sequence
  source: /note="Description of Artificial Sequence: Synthetic oligonucleotide"
ccuccagggauugguaugugu

SEQ ID NO: 573 - RNA, 21 nt, Artificial Sequence
  source: /note="Description of Artificial Sequence: Synthetic oligonucleotide"
uuucuucagcaaacucuauaa

SEQ ID NO: 574 - RNA, 21 nt, Artificial Sequence
  source: /note="Description of Artificial Sequence: Synthetic oligonucleotide"
uguucccaaaauuauggcuuu

SEQ ID NO: 575 - RNA, 21 nt, Artificial Sequence
  source: /note="Description of Artificial Sequence: Synthetic oligonucleotide"
uuucuaucaucuuccuucaua

SEQ ID NO: 576 - RNA, 21 nt, Artificial Sequence
  source: /note="Description of Artificial Sequence: Synthetic oligonucleotide"
cuuuaaggaguucaucuaccu

SEQ ID NO: 577 - RNA, 21 nt, Artificial Sequence
  source: /note="Description of Artificial Sequence: Synthetic oligonucleotide"
uguuuguguucaacaauuguu

SEQ ID NO: 578 - RNA, 21 nt, Artificial Sequence
  source: /note="Description of Artificial Sequence: Synthetic oligonucleotide"
acuguucaacuguggauaucu

SEQ ID NO: 579 - RNA, 21 nt, Artificial Sequence
  source: /note="Description of Artificial Sequence: Synthetic oligonucleotide"
uaacguaacucuuucuaugcu

SEQ ID NO: 580 - RNA, 21 nt, Artificial Sequence
  source: /note="Description of Artificial Sequence: Synthetic oligonucleotide"
ucugaggaacaguuccuauuu

SEQ ID NO: 581 - RNA, 21 nt, Artificial Sequence
  source: /note="Description of Artificial Sequence: Synthetic oligonucleotide"
ucauaaucacauucguuuguu

SEQ ID NO: 582 - RNA, 21 nt, Artificial Sequence
  source: /note="Description of Artificial Sequence: Synthetic oligonucleotide"
auggauucuaaucuuccaagu

SEQ ID NO: 583 - RNA, 21 nt, Artificial Sequence
  source: /note="Description of Artificial Sequence: Synthetic oligonucleotide"
ugaacugacguuacaucauau

SEQ ID NO: 584 - RNA, 21 nt, Artificial Sequence
  source: /note="Description of Artificial Sequence: Synthetic oligonucleotide"
ucuauaaaguuccucuugaca

SEQ ID NO: 585 - RNA, 21 nt, Artificial Sequence
  source: /note="Description of Artificial Sequence: Synthetic oligonucleotide"
gcuauucauaaucacauucgu

SEQ ID NO: 586 - RNA, 21 nt, Artificial Sequence
  source: /note="Description of Artificial Sequence: Synthetic oligonucleotide"
gcuacuaaaugugcucuuagu

SEQ ID NO: 587 - RNA, 21 nt, Artificial Sequence
  source: /note="Description of Artificial Sequence: Synthetic oligonucleotide"
gcuuuaaaacaguacacgacu

SEQ ID NO: 588 - RNA, 21 nt, Artificial Sequence
  source: /note="Description of Artificial Sequence: Synthetic oligonucleotide"
agguuuaugaacugacguuau

SEQ ID NO: 589 - RNA, 21 nt, Artificial Sequence
  source: /note="Description of Artificial Sequence: Synthetic oligonucleotide"
ucaacaauuguugaagacucu

SEQ ID NO: 590 - RNA, 21 nt, Artificial Sequence
  source: /note="Description of Artificial Sequence: Synthetic oligonucleotide"
gcaacauacuuucuauugcca

SEQ ID NO: 591 - RNA, 21 nt, Artificial Sequence
  source: /note="Description of Artificial Sequence: Synthetic oligonucleotide"
auuuccguuguacauguuccu

SEQ ID NO: 592 - RNA, 21 nt, Artificial Sequence
  source: /note="Description of Artificial Sequence: Synthetic oligonucleotide"
cuccgucagcacaauaaccau

SEQ ID NO: 593 - RNA, 21 nt, Artificial Sequence
  source: /note="Description of Artificial Sequence: Synthetic oligonucleotide"
ugguucaguuacggguuaauu

SEQ ID NO: 594 - RNA, 21 nt, Artificial Sequence
  source: /note="Description of Artificial Sequence: Synthetic oligonucleotide"
uucuaaucuuccaagguuaca

SEQ ID NO: 595 - RNA, 21 nt, Artificial Sequence
  source: /note="Description of Artificial Sequence: Synthetic oligonucleotide"
gaguauuguggaacuuauagu

SEQ ID NO: 596 - RNA, 21 nt, Artificial Sequence
  source: /note="Description of Artificial Sequence: Synthetic oligonucleotide"
gauauuguucuuucucguauu

SEQ ID NO: 597 - RNA, 21 nt, Artificial Sequence
  source: /note="Description of Artificial Sequence: Synthetic oligonucleotide"
cuagacaaucugauaccucau

SEQ ID NO: 598 - RNA, 21 nt, Artificial Sequence
  source: /note="Description of Artificial Sequence: Synthetic oligonucleotide"
cgccuuuuaucugcuucguuu

SEQ ID NO: 599 - RNA, 21 nt, Artificial Sequence
  source: /note="Description of Artificial Sequence: Synthetic oligonucleotide"
uaugaacgcuaucauucaaaa

SEQ ID NO: 600 - RNA, 21 nt, Artificial Sequence
  source: /note="Description of Artificial Sequence: Synthetic oligonucleotide"
ugaaauuguguuagacgguau

SEQ ID NO: 601 - RNA, 21 nt, Artificial Sequence
  source: /note="Description of Artificial Sequence: Synthetic oligonucleotide"
aucuucaagucuggaauguuu

SEQ ID NO: 602 - RNA, 21 nt, Artificial Sequence
  source: /note="Description of Artificial Sequence: Synthetic oligonucleotide"
uccguuguacauguuccuguu

SEQ ID NO: 603 - RNA, 21 nt, Artificial Sequence
  source: /note="Description of Artificial Sequence: Synthetic oligonucleotide"
gcuucuagacaaucugauacu

SEQ ID NO: 604 - RNA, 21 nt, Artificial Sequence
  source: /note="Description of Artificial Sequence: Synthetic oligonucleotide"
uucaguuacggguuaauuacu

SEQ ID NO: 605 - RNA, 21 nt, Artificial Sequence
  source: /note="Description of Artificial Sequence: Synthetic oligonucleotide"
caugcaagacucacuuagucu

SEQ ID NO: 606 - RNA, 21 nt, Artificial Sequence
  source: /note="Description of Artificial Sequence: Synthetic oligonucleotide"
gaugacucugaaucgagaucu

SEQ ID NO: 607 - RNA, 21 nt, Artificial Sequence
  source: /note="Description of Artificial Sequence: Synthetic oligonucleotide"
aggcuauaaccuacuaccaau

SEQ ID NO: 608 - RNA, 21 nt, Artificial Sequence
  source: /note="Description of Artificial Sequence: Synthetic oligonucleotide"
acucugaaucgagaucggauu

SEQ ID NO: 609 - RNA, 21 nt, Artificial Sequence
  source: /note="Description of Artificial Sequence: Synthetic oligonucleotide"
accuacuaccaagcauaacau

SEQ ID NO: 610 - RNA, 21 nt, Artificial Sequence
  source: /note="Description of Artificial Sequence: Synthetic oligonucleotide"
ucugaaucgagaucggauguu

SEQ ID NO: 611 - RNA, 21 nt, Artificial Sequence
  source: /note="Description of Artificial Sequence: Synthetic oligonucleotide"
agguccuguuacaacaaguaa

SEQ ID NO: 612 - RNA, 21 nt, Artificial Sequence
  source: /note="Description of Artificial Sequence: Synthetic oligonucleotide"
acagcaguguugauaaauuug

SEQ ID NO: 613 - RNA, 21 nt, Artificial Sequence
  source: /note="Description of Artificial Sequence: Synthetic oligonucleotide"
gguccuguuacaacaaguaaa

SEQ ID NO: 614 - RNA, 21 nt, Artificial Sequence
  source: /note="Description of Artificial Sequence: Synthetic oligonucleotide"
uugaacuacaucgaucaugga

SEQ ID NO: 615 - RNA, 21 nt, Artificial Sequence
  source: /note="Description of Artificial Sequence: Synthetic oligonucleotide"
acucggaguucaaccuaagcu

SEQ ID NO: 616 - RNA, 21 nt, Artificial Sequence
  source: /note="Description of Artificial Sequence: Synthetic oligonucleotide"
cucugaggaacaguuccuauu

SEQ ID NO: 617 - RNA, 21 nt, Artificial Sequence
  source: /note="Description of Artificial Sequence: Synthetic oligonucleotide"
cugaggaacaguuccuauugu

SEQ ID NO: 618 - RNA, 21 nt, Artificial Sequence
  source: /note="Description of Artificial Sequence: Synthetic oligonucleotide"
aucauuauacagggcuuuuaa

SEQ ID NO: 619 - RNA, 23 nt, Artificial Sequence
  source: /note="Description of Artificial Sequence: Synthetic oligonucleotide"
uuugauaaaaaguuuuagucccu

SEQ ID NO: 620 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagtagcugguaacagagaa

SEQ ID NO: 621 - RNA, 23 nt, Artificial Sequence
  source: /note="Description of Artificial Sequence: Synthetic oligonucleotide"
ugguaacagagaagggacaggau

SEQ ID NO: 622 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucagatgcuagacucacaaagc

SEQ ID NO: 623 - RNA, 23 nt, Artificial Sequence
  source: /note="Description of Artificial Sequence: Synthetic oligonucleotide"
aaucgaaccacuucacugaucag

SEQ ID NO: 624 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accgagtuuccauaccagaggag

SEQ ID NO: 625 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuagctugaccaaggacucugu

SEQ ID NO: 626 - RNA, 23 nt, Artificial Sequence
  source: /note="Description of Artificial Sequence: Synthetic oligonucleotide"
agccaaaaggcuuagguugaacu

SEQ ID NO: 627 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acacuctccguaguucugucagc

SEQ ID NO: 628 - RNA, 23 nt, Artificial Sequence
  source: /note="Description of Artificial Sequence: Synthetic oligonucleotide"
augugacaagcacacauggaggg

SEQ ID NO: 629 - RNA, 23 nt, Artificial Sequence
  source: /note="Description of Artificial Sequence: Synthetic oligonucleotide"
auuucaaacuggguacguucggu

SEQ ID NO: 630 - RNA, 23 nt, Artificial Sequence
  source: /note="Description of Artificial Sequence: Synthetic oligonucleotide"
aagacugguaugaugugguauca

SEQ ID NO: 631 - RNA, 23 nt, Artificial Sequence
  source: /note="Description of Artificial Sequence: Synthetic oligonucleotide"
aauaaacuuugucacaugcagca

SEQ ID NO: 632 - RNA, 23 nt, Artificial Sequence
  source: /note="Description of Artificial Sequence: Synthetic oligonucleotide"
gaaacugcgaacaggagugaaua

SEQ ID NO: 633 - RNA, 23 nt, Artificial Sequence
  source: /note="Description of Artificial Sequence: Synthetic oligonucleotide"
augguaacagagaagggacagga

SEQ ID NO: 634 - RNA, 23 nt, Artificial Sequence
  source: /note="Description of Artificial Sequence: Synthetic oligonucleotide"
aaauugagucccauucucagaug

SEQ ID NO: 635 - RNA, 23 nt, Artificial Sequence
  source: /note="Description of Artificial Sequence: Synthetic oligonucleotide"
aaugaggaucucaucuucugaag

SEQ ID NO: 636 - RNA, 23 nt, Artificial Sequence
  source: /note="Description of Artificial Sequence: Synthetic oligonucleotide"
aguaucgagagccuucaguggcu

SEQ ID NO: 637 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauagctacaaucacagacucgc

SEQ ID NO: 638 - RNA, 23 nt, Artificial Sequence
  source: /note="Description of Artificial Sequence: Synthetic oligonucleotide"
aucauggaucaaaugccaugaca

SEQ ID NO: 639 - RNA, 23 nt, Artificial Sequence
  source: /note="Description of Artificial Sequence: Synthetic oligonucleotide"
acaacacauagaggaugccgugc

SEQ ID NO: 640 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agccautagcaaucucgcucaug

SEQ ID NO: 641 - RNA, 23 nt, Artificial Sequence
  source: /note="Description of Artificial Sequence: Synthetic oligonucleotide"
aucuccguaguucugucagcguc

SEQ ID NO: 642 - RNA, 23 nt, Artificial Sequence
  source: /note="Description of Artificial Sequence: Synthetic oligonucleotide"
auuggaguaugugaccugcuuuc

SEQ ID NO: 643 - RNA, 23 nt, Artificial Sequence
  source: /note="Description of Artificial Sequence: Synthetic oligonucleotide"
aagauagucacuaacaacuggaa

SEQ ID NO: 644 - RNA, 23 nt, Artificial Sequence
  source: /note="Description of Artificial Sequence: Synthetic oligonucleotide"
aagaucgaaccacuucacugauc

SEQ ID NO: 645 - RNA, 23 nt, Artificial Sequence
  source: /note="Description of Artificial Sequence: Synthetic oligonucleotide"
agaucgaaccacuucacugauca

SEQ ID NO: 646 - RNA, 23 nt, Artificial Sequence
  source: /note="Description of Artificial Sequence: Synthetic oligonucleotide"
aagugugacaagcacacauggag

SEQ ID NO: 647 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuguatcacagaugcugaaaau

SEQ ID NO: 648 - RNA, 23 nt, Artificial Sequence
  source: /note="Description of Artificial Sequence: Synthetic oligonucleotide"
aaaucugguaucgagagccuuca

SEQ ID NO: 649 - RNA, 23 nt, Artificial Sequence
  source: /note="Description of Artificial Sequence: Synthetic oligonucleotide"
aagguggaaagaagucaucuagg

SEQ ID NO: 650 - RNA, 23 nt, Artificial Sequence
  source: /note="Description of Artificial Sequence: Synthetic oligonucleotide"
aacacgaguauagcuguuaacua

SEQ ID NO: 651 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcuautccuuugagguuggaca

SEQ ID NO: 652 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacucutuuggccauuagcaauc

SEQ ID NO: 653 - RNA, 23 nt, Artificial Sequence
  source: /note="Description of Artificial Sequence: Synthetic oligonucleotide"
uccuuugagguuggacagcagau

SEQ ID NO: 654 - RNA, 23 nt, Artificial Sequence
  source: /note="Description of Artificial Sequence: Synthetic oligonucleotide"
uuucaaacuggguacguucggug

SEQ ID NO: 655 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuguataucugagucuacuucc

SEQ ID NO: 656 - RNA, 23 nt, Artificial Sequence
  source: /note="Description of Artificial Sequence: Synthetic oligonucleotide"
ucacuaacaacuggaaugagcug

SEQ ID NO: 657 - RNA, 23 nt, Artificial Sequence
  source: /note="Description of Artificial Sequence: Synthetic oligonucleotide"
agagaucgaaccacuucacugau

SEQ ID NO: 658 - RNA, 23 nt, Artificial Sequence
  source: /note="Description of Artificial Sequence: Synthetic oligonucleotide"
auuuuggccauuagcaaucucgc

SEQ ID NO: 659 - RNA, 23 nt, Artificial Sequence
  source: /note="Description of Artificial Sequence: Synthetic oligonucleotide"
acuuagcuugaccaaggacucug

SEQ ID NO: 660 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaaatcugguaucgagagccu

SEQ ID NO: 661 - RNA, 23 nt, Artificial Sequence
  source: /note="Description of Artificial Sequence: Synthetic oligonucleotide"
uuccauaaacuuugucacaugca

SEQ ID NO: 662 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acgagutuccauaccagaggagg

SEQ ID NO: 663 - RNA, 23 nt, Artificial Sequence
  source: /note="Description of Artificial Sequence: Synthetic oligonucleotide"
ugggcuauuccuuugagguugga

SEQ ID NO: 664 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacuctuuuggccauuagcaau

SEQ ID NO: 665 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacacutuacacgggcauaggaa

SEQ ID NO: 666 - RNA, 23 nt, Artificial Sequence
  source: /note="Description of Artificial Sequence: Synthetic oligonucleotide"
auccguaguucugucagcgucag

SEQ ID NO: 667 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaggutuuguauaucugagucu

SEQ ID NO: 668 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacauctugagguggaaagaagu

SEQ ID NO: 669 - RNA, 23 nt, Artificial Sequence
  source: /note="Description of Artificial Sequence: Synthetic oligonucleotide"
acuacaaucacagacucgcuguc

SEQ ID NO: 670 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agguuutguauaucugagucuac

SEQ ID NO: 671 - RNA, 23 nt, Artificial Sequence
  source: /note="Description of Artificial Sequence: Synthetic oligonucleotide"
ucucagaugcuagacucacaaag

SEQ ID NO: 672 - RNA, 23 nt, Artificial Sequence
  source: /note="Description of Artificial Sequence: Synthetic oligonucleotide"
acgaacaggagugaauaucaacc

SEQ ID NO: 673 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accgactagacugaguagcuaca

SEQ ID NO: 674 - RNA, 23 nt, Artificial Sequence
  source: /note="Description of Artificial Sequence: Synthetic oligonucleotide"
agaauugacuggagacacaggug

SEQ ID NO: 675 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaacatagugcauguucccugc

SEQ ID NO: 676 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaggutguacugcaauggcuuc

SEQ ID NO: 677 - RNA, 23 nt, Artificial Sequence
  source: /note="Description of Artificial Sequence: Synthetic oligonucleotide"
uguuugguagggaaccuugcauc

SEQ ID NO: 678 - RNA, 23 nt, Artificial Sequence
  source: /note="Description of Artificial Sequence: Synthetic oligonucleotide"
agcauuacuccacacaucuguau

SEQ ID NO: 679 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaaactuugucacaugcagcac

SEQ ID NO: 680 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacuutgucacaugcagcacag

SEQ ID NO: 681 - RNA, 23 nt, Artificial Sequence
  source: /note="Description of Artificial Sequence: Synthetic oligonucleotide"
acauaaacuuugucacaugcagc

SEQ ID NO: 682 - RNA, 23 nt, Artificial Sequence
  source: /note="Description of Artificial Sequence: Synthetic oligonucleotide"
acacgaguauagcuguuaacuag

SEQ ID NO: 683 - RNA, 23 nt, Artificial Sequence
  source: /note="Description of Artificial Sequence: Synthetic oligonucleotide"
agcuuagguugaacuccgagcuc

SEQ ID NO: 684 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaccactucacugaucaggauga

SEQ ID NO: 685 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagactcacaaagcugacugua

SEQ ID NO: 686 - RNA, 23 nt, Artificial Sequence
  source: /note="Description of Artificial Sequence: Synthetic oligonucleotide"
augcgaacaggagugaauaucaa

SEQ ID NO: 687 - RNA, 23 nt, Artificial Sequence
  source: /note="Description of Artificial Sequence: Synthetic oligonucleotide"
aagacuaggagagugcaucaaca

SEQ ID NO: 688 - RNA, 23 nt, Artificial Sequence
  source: /note="Description of Artificial Sequence: Synthetic oligonucleotide"
aacugagguuuuguauaucugag

SEQ ID NO: 689 - RNA, 23 nt, Artificial Sequence
  source: /note="Description of Artificial Sequence: Synthetic oligonucleotide"
uuagcaaucucgcucaugccaag

SEQ ID NO: 690 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaaggtucacauccaccuguuc

SEQ ID NO: 691 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuaggtugaacuccgagcucau

SEQ ID NO: 692 - RNA, 23 nt, Artificial Sequence
  source: /note="Description of Artificial Sequence: Synthetic oligonucleotide"
ugcagaagauacaaagggacaga

SEQ ID NO: 693 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaacatcuaccaugaggaguaa

SEQ ID NO: 694 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaauctgguaucgagagccuuc

SEQ ID NO: 695 - RNA, 23 nt, Artificial Sequence
  source: /note="Description of Artificial Sequence: Synthetic oligonucleotide"
aggcuuagguugaacuccgagcu

SEQ ID NO: 696 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauucctuugagguuggacagca

SEQ ID NO: 697 - RNA, 23 nt, Artificial Sequence
  source: /note="Description of Artificial Sequence: Synthetic oligonucleotide"
aaaauugagucccauucucagau

SEQ ID NO: 698 - RNA, 23 nt, Artificial Sequence
  source: /note="Description of Artificial Sequence: Synthetic oligonucleotide"
acuucacugaucaggaugacggg

SEQ ID NO: 699 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauagctcagagacaccuuuggg

SEQ ID NO: 700 - RNA, 23 nt, Artificial Sequence
  source: /note="Description of Artificial Sequence: Synthetic oligonucleotide"
ugauaagagcaccuguaguagcu

SEQ ID NO: 701 - RNA, 23 nt, Artificial Sequence
  source: /note="Description of Artificial Sequence: Synthetic oligonucleotide"
auuagcaaucucgcucaugccaa

SEQ ID NO: 702 - RNA, 23 nt, Artificial Sequence
  source: /note="Description of Artificial Sequence: Synthetic oligonucleotide"
aauugcaaagcacuccugccauu

SEQ ID NO: 703 - RNA, 23 nt, Artificial Sequence
  source: /note="Description of Artificial Sequence: Synthetic oligonucleotide"
ucuuccaaaucugguaucgagag

SEQ ID NO: 704 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacgagtauagcuguuaacuagg

SEQ ID NO: 705 - RNA, 23 nt, Artificial Sequence
  source: /note="Description of Artificial Sequence: Synthetic oligonucleotide"
uaugaacaucuaccaugaggagu

SEQ ID NO: 706 - RNA, 23 nt, Artificial Sequence
  source: /note="Description of Artificial Sequence: Synthetic oligonucleotide"
aaacugcgaacaggagugaauau

SEQ ID NO: 707 - RNA, 23 nt, Artificial Sequence
  source: /note="Description of Artificial Sequence: Synthetic oligonucleotide"
ugacugagguuuuguauaucuga

SEQ ID NO: 708 - RNA, 23 nt, Artificial Sequence
  source: /note="Description of Artificial Sequence: Synthetic oligonucleotide"
accaaaaggcuuagguugaacuc

SEQ ID NO: 709 - RNA, 23 nt, Artificial Sequence
  source: /note="Description of Artificial Sequence: Synthetic oligonucleotide"
acucuccguaguucugucagcgu

SEQ ID NO: 710 - RNA, 23 nt, Artificial Sequence
  source: /note="Description of Artificial Sequence: Synthetic oligonucleotide"
uccugaaggguacaugugcagac

SEQ ID NO: 711 - RNA, 23 nt, Artificial Sequence
  source: /note="Description of Artificial Sequence: Synthetic oligonucleotide"
acacuucacugaucaggaugacg

SEQ ID NO: 712 - RNA, 23 nt, Artificial Sequence
  source: /note="Description of Artificial Sequence: Synthetic oligonucleotide"
aauuagcaaucucgcucaugcca

SEQ ID NO: 713 - RNA, 23 nt, Artificial Sequence
  source: /note="Description of Artificial Sequence: Synthetic oligonucleotide"
aaacauagugcauguucccugca

SEQ ID NO: 714 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acugaatacgagaaagaacaaua

SEQ ID NO: 715 - RNA, 23 nt, Artificial Sequence
  source: /note="Description of Artificial Sequence: Synthetic oligonucleotide"
ugaauagcauucuuaucugcacg

SEQ ID NO: 716 - RNA, 23 nt, Artificial Sequence
  source: /note="Description of Artificial Sequence: Synthetic oligonucleotide"
agaggaacuuuauagaguuugcu

SEQ ID NO: 717 - RNA, 23 nt, Artificial Sequence
  source: /note="Description of Artificial Sequence: Synthetic oligonucleotide"
uacgagaaagaacaauaucuuca

SEQ ID NO: 718 - RNA, 23 nt, Artificial Sequence
  source: /note="Description of Artificial Sequence: Synthetic oligonucleotide"
aucaugcaugagaaguuucaggu

SEQ ID NO: 719 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugautaugaauagcauucuua

SEQ ID NO: 720 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagcuutgauaacuuuguugagg

SEQ ID NO: 721 - RNA, 23 nt, Artificial Sequence
  source: /note="Description of Artificial Sequence: Synthetic oligonucleotide"
uguaugauguaacgucaguucau

SEQ ID NO: 722 - RNA, 23 nt, Artificial Sequence
  source: /note="Description of Artificial Sequence: Synthetic oligonucleotide"
agacuaaagcaggauuucaggua

SEQ ID NO: 723 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacatauugucagacaaugau

SEQ ID NO: 724 - RNA, 23 nt, Artificial Sequence
  source: /note="Description of Artificial Sequence: Synthetic oligonucleotide"
ucuucaaacugaguacgacuggu

SEQ ID NO: 725 - RNA, 23 nt, Artificial Sequence
  source: /note="Description of Artificial Sequence: Synthetic oligonucleotide"
acccgacuagacugaguagcuac

SEQ ID NO: 726 - RNA, 23 nt, Artificial Sequence
  source: /note="Description of Artificial Sequence: Synthetic oligonucleotide"
uuuuauaacaagagguucaaaca

SEQ ID NO: 727 - RNA, 23 nt, Artificial Sequence
  source: /note="Description of Artificial Sequence: Synthetic oligonucleotide"
uuuauaacaagagguucaaacaa

SEQ ID NO: 728 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaugatcgauguaguucaagau

SEQ ID NO: 729 - RNA, 23 nt, Artificial Sequence
  source: /note="Description of Artificial Sequence: Synthetic oligonucleotide"
uccugaauacgagaaagaacaau

SEQ ID NO: 730 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucagatugucuagaagcugcac

SEQ ID NO: 731 - RNA, 23 nt, Artificial Sequence
  source: /note="Description of Artificial Sequence: Synthetic oligonucleotide"
uuauaacaagagguucaaacaaa

SEQ ID NO: 732 - RNA, 23 nt, Artificial Sequence
  source: /note="Description of Artificial Sequence: Synthetic oligonucleotide"
aguuggaguugaaagguuuucac

SEQ ID NO: 733 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguguatgauguaacgucaguuc

SEQ ID NO: 734 - RNA, 23 nt, Artificial Sequence
  source: /note="Description of Artificial Sequence: Synthetic oligonucleotide"
uugguucucgacuaaagcaggau

SEQ ID NO: 735 - RNA, 23 nt, Artificial Sequence
  source: /note="Description of Artificial Sequence: Synthetic oligonucleotide"
uaaacaccugaucugaauccaga

SEQ ID NO: 736 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuucgtaaacaagucagcagcc

SEQ ID NO: 737 - RNA, 23 nt, Artificial Sequence
  source: /note="Description of Artificial Sequence: Synthetic oligonucleotide"
uaggagagugcaucaacaccagg

SEQ ID NO: 738 - RNA, 23 nt, Artificial Sequence
  source: /note="Description of Artificial Sequence: Synthetic oligonucleotide"
uuuaggaauuccaaugaucuguu

SEQ ID NO: 739 - RNA, 23 nt, Artificial Sequence
  source: /note="Description of Artificial Sequence: Synthetic oligonucleotide"
auccugaauacgagaaagaacaa

SEQ ID NO: 740 - RNA, 23 nt, Artificial Sequence
  source: /note="Description of Artificial Sequence: Synthetic oligonucleotide"
auaucagauugucuagaagcugc

SEQ ID NO: 741 - RNA, 23 nt, Artificial Sequence
  source: /note="Description of Artificial Sequence: Synthetic oligonucleotide"
uguaauagaaaccuugaaaaugu

SEQ ID NO: 742 - RNA, 23 nt, Artificial Sequence
  source: /note="Description of Artificial Sequence: Synthetic oligonucleotide"
agguaucagauugucuagaagcu

SEQ ID NO: 743 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucgugtacuguuuuaaagcuuu

SEQ ID NO: 744 - RNA, 23 nt, Artificial Sequence
  source: /note="Description of Artificial Sequence: Synthetic oligonucleotide"
aagauuagaauccaucaaagcuu

SEQ ID NO: 745 - RNA, 23 nt, Artificial Sequence
  source: /note="Description of Artificial Sequence: Synthetic oligonucleotide"
auguguaugauguaacgucaguu

SEQ ID NO: 746 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuggutcucgacuaaagcagga

SEQ ID NO: 747 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugugutuggagugacgaacaua

SEQ ID NO: 748 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agacautucguaaacaagucagc

SEQ ID NO: 749 - RNA, 23 nt, Artificial Sequence
  source: /note="Description of Artificial Sequence: Synthetic oligonucleotide"
acuaggagagugcaucaacacca

SEQ ID NO: 750 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccutggaagauuagaaucca

SEQ ID NO: 751 - RNA, 23 nt, Artificial Sequence
  source: /note="Description of Artificial Sequence: Synthetic oligonucleotide"
uugaaagguuuucacaacgagac

SEQ ID NO: 752 - RNA, 23 nt, Artificial Sequence
  source: /note="Description of Artificial Sequence: Synthetic oligonucleotide"
ugagguaucagauugucuagaag

SEQ ID NO: 753 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagcutugauaacuuuguugag

SEQ ID NO: 754 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuugtuguaacaggaccugag

SEQ ID NO: 755 - RNA, 23 nt, Artificial Sequence
  source: /note="Description of Artificial Sequence: Synthetic oligonucleotide"
auaauuaacccguaacugaacca

SEQ ID NO: 756 - RNA, 23 nt, Artificial Sequence
  source: /note="Description of Artificial Sequence: Synthetic oligonucleotide"
auucaaacugaguacgacugguc

SEQ ID NO: 757 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accguctaacacaauuucagaac

SEQ ID NO: 758 - RNA, 23 nt, Artificial Sequence
  source: /note="Description of Artificial Sequence: Synthetic oligonucleotide"
uguugaacacaaacaguugccau

SEQ ID NO: 759 - RNA, 23 nt, Artificial Sequence
  source: /note="Description of Artificial Sequence: Synthetic oligonucleotide"
aauuguguuuggagugacgaaca

SEQ ID NO: 760 - RNA, 23 nt, Artificial Sequence
  source: /note="Description of Artificial Sequence: Synthetic oligonucleotide"
aauguacaacggaaaugucagcg

SEQ ID NO: 761 - RNA, 23 nt, Artificial Sequence
  source: /note="Description of Artificial Sequence: Synthetic oligonucleotide"
auaaagggcacuuggcaguggcu

SEQ ID NO: 762 - RNA, 23 nt, Artificial Sequence
  source: /note="Description of Artificial Sequence: Synthetic oligonucleotide"
uaacgucaguucauaaaccugga

SEQ ID NO: 763 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaacctuggaagauuagaaucc

SEQ ID NO: 764 - RNA, 23 nt, Artificial Sequence
  source: /note="Description of Artificial Sequence: Synthetic oligonucleotide"
acagugaugaggauuuacuuguu

SEQ ID NO: 765 - RNA, 23 nt, Artificial Sequence
  source: /note="Description of Artificial Sequence: Synthetic oligonucleotide"
uggaagauuagaauccaucaaag

SEQ ID NO: 766 - RNA, 23 nt, Artificial Sequence
  source: /note="Description of Artificial Sequence: Synthetic oligonucleotide"
aaugcaguuugagguaugaagga

SEQ ID NO: 767 - RNA, 23 nt, Artificial Sequence
  source: /note="Description of Artificial Sequence: Synthetic oligonucleotide"
uguuucaauacaaagccaauaaa

SEQ ID NO: 768 - RNA, 23 nt, Artificial Sequence
  source: /note="Description of Artificial Sequence: Synthetic oligonucleotide"
aauuucguaaacaagucagcagc

SEQ ID NO: 769 - RNA, 23 nt, Artificial Sequence
  source: /note="Description of Artificial Sequence: Synthetic oligonucleotide"
uaccgucuaacacaauuucagaa

SEQ ID NO: 770 - RNA, 23 nt, Artificial Sequence
  source: /note="Description of Artificial Sequence: Synthetic oligonucleotide"
acaaacgaaugugauuaugaaua

SEQ ID NO: 771 - RNA, 23 nt, Artificial Sequence
  source: /note="Description of Artificial Sequence: Synthetic oligonucleotide"
uuucacaacgagacugaauugcc

SEQ ID NO: 772 - RNA, 23 nt, Artificial Sequence
  source: /note="Description of Artificial Sequence: Synthetic oligonucleotide"
aacgucaguucauaaaccuggac

SEQ ID NO: 773 - RNA, 23 nt, Artificial Sequence
  source: /note="Description of Artificial Sequence: Synthetic oligonucleotide"
acacauaccaaucccuggaggac

SEQ ID NO: 774 - RNA, 23 nt, Artificial Sequence
  source: /note="Description of Artificial Sequence: Synthetic oligonucleotide"
uuauagaguuugcugaagaaaga

SEQ ID NO: 775 - RNA, 23 nt, Artificial Sequence
  source: /note="Description of Artificial Sequence: Synthetic oligonucleotide"
aaagccauaauuuugggaacagc

SEQ ID NO: 776 - RNA, 23 nt, Artificial Sequence
  source: /note="Description of Artificial Sequence: Synthetic oligonucleotide"
uaugaaggaagaugauagaaacu

SEQ ID NO: 777 - RNA, 23 nt, Artificial Sequence
  source: /note="Description of Artificial Sequence: Synthetic oligonucleotide"
agguagaugaacuccuuaaagac

SEQ ID NO: 778 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaautguugaacacaaacagu

SEQ ID NO: 779 - RNA, 23 nt, Artificial Sequence
  source: /note="Description of Artificial Sequence: Synthetic oligonucleotide"
agauauccacaguugaacagugc

SEQ ID NO: 780 - RNA, 23 nt, Artificial Sequence
  source: /note="Description of Artificial Sequence: Synthetic oligonucleotide"
agcauagaaagaguuacguuaaa

SEQ ID NO: 781 - RNA, 23 nt, Artificial Sequence
  source: /note="Description of Artificial Sequence: Synthetic oligonucleotide"
aaauaggaacuguuccucagagu

SEQ ID NO: 782 - RNA, 23 nt, Artificial Sequence
  source: /note="Description of Artificial Sequence: Synthetic oligonucleotide"
aacaaacgaaugugauuaugaau

SEQ ID NO: 783 - RNA, 23 nt, Artificial Sequence
  source: /note="Description of Artificial Sequence: Synthetic oligonucleotide"
acuuggaagauuagaauccauca

SEQ ID NO: 784 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaugatguaacgucaguucaua

SEQ ID NO: 785 - RNA, 23 nt, Artificial Sequence
  source: /note="Description of Artificial Sequence: Synthetic oligonucleotide"
ugucaagaggaacuuuauagagu

SEQ ID NO: 786 - RNA, 23 nt, Artificial Sequence
  source: /note="Description of Artificial Sequence: Synthetic oligonucleotide"
acgaaugugauuaugaauagcau

SEQ ID NO: 787 - RNA, 23 nt, Artificial Sequence
  source: /note="Description of Artificial Sequence: Synthetic oligonucleotide"
acuaagagcacauuuaguagcca

SEQ ID NO: 788 - RNA, 23 nt, Artificial Sequence
  source: /note="Description of Artificial Sequence: Synthetic oligonucleotide"
agucguguacuguuuuaaagcuu

SEQ ID NO: 789 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaacgtcaguucauaaaccugg

SEQ ID NO: 790 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaguctucaacaauuguugaac

SEQ ID NO: 791 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcaatagaaaguauguugcug

SEQ ID NO: 792 - RNA, 23 nt, Artificial Sequence
  source: /note="Description of Artificial Sequence: Synthetic oligonucleotide"
aggaacauguacaacggaaaugu

SEQ ID NO: 793 - RNA, 23 nt, Artificial Sequence
  source: /note="Description of Artificial Sequence: Synthetic oligonucleotide"
augguuauugugcugacggagaa

SEQ ID NO: 794 - RNA, 23 nt, Artificial Sequence
  source: /note="Description of Artificial Sequence: Synthetic oligonucleotide"
aauuaacccguaacugaaccagc

SEQ ID NO: 795 - RNA, 23 nt, Artificial Sequence
  source: /note="Description of Artificial Sequence: Synthetic oligonucleotide"
uguaaccuuggaagauuagaauc

SEQ ID NO: 796 - RNA, 23 nt, Artificial Sequence
  source: /note="Description of Artificial Sequence: Synthetic oligonucleotide"
acuauaaguuccacaauacuccc

SEQ ID NO: 797 - RNA, 23 nt, Artificial Sequence
  source: /note="Description of Artificial Sequence: Synthetic oligonucleotide"
aauacgagaaagaacaauaucuu

SEQ ID NO: 798 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augaggtaucagauugucuagaa

SEQ ID NO: 799 - RNA, 23 nt, Artificial Sequence
  source: /note="Description of Artificial Sequence: Synthetic oligonucleotide"
aaacgaagcagauaaaaggcgga

SEQ ID NO: 800 - RNA, 23 nt, Artificial Sequence
  source: /note="Description of Artificial Sequence: Synthetic oligonucleotide"
uuuugaaugauagcguucauaag

SEQ ID NO: 801 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auaccgtcuaacacaauuucaga

SEQ ID NO: 802 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaacautccagacuugaagaugu

SEQ ID NO: 803 - RNA, 23 nt, Artificial Sequence
  source: /note="Description of Artificial Sequence: Synthetic oligonucleotide"
aacaggaacauguacaacggaaa

SEQ ID NO: 804 - RNA, 23 nt, Artificial Sequence
  source: /note="Description of Artificial Sequence: Synthetic oligonucleotide"
aguaucagauugucuagaagcug

SEQ ID NO: 805 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguaautaacccguaacugaacc

SEQ ID NO: 806 - RNA, 23 nt, Artificial Sequence
  source: /note="Description of Artificial Sequence: Synthetic oligonucleotide"
agacuaagugagucuugcauggu

SEQ ID NO: 807 - RNA, 23 nt, Artificial Sequence
  source: /note="Description of Artificial Sequence: Synthetic oligonucleotide"
agaucucgauucagagucauccu

SEQ ID NO: 808 - RNA, 23 nt, Artificial Sequence
  source: /note="Description of Artificial Sequence: Synthetic oligonucleotide"
auugguaguagguuauagccucu

SEQ ID NO: 809 - RNA, 23 nt, Artificial Sequence
  source: /note="Description of Artificial Sequence: Synthetic oligonucleotide"
aauccgaucucgauucagaguca

SEQ ID NO: 810 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguuatgcuugguaguagguua

SEQ ID NO: 811 - RNA, 23 nt, Artificial Sequence
  source: /note="Description of Artificial Sequence: Synthetic oligonucleotide"
aacauccgaucucgauucagagu

SEQ ID NO: 812 - RNA, 23 nt, Artificial Sequence
  source: /note="Description of Artificial Sequence: Synthetic oligonucleotide"
uuacuuguuguaacaggaccuga

SEQ ID NO: 813 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaauutaucaacacugcuguca

SEQ ID NO: 814 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuacutguuguaacaggaccug

SEQ ID NO: 815 - RNA, 23 nt, Artificial Sequence
  source: /note="Description of Artificial Sequence: Synthetic oligonucleotide"
uccaugaucgauguaguucaaga

SEQ ID NO: 816 - RNA, 23 nt, Artificial Sequence
  source: /note="Description of Artificial Sequence: Synthetic oligonucleotide"
agcuuagguugaacuccgaguuc

SEQ ID NO: 817 - RNA, 23 nt, Artificial Sequence
  source: /note="Description of Artificial Sequence: Synthetic oligonucleotide"
aauaggaacuguuccucagaguc

SEQ ID NO: 818 - RNA, 23 nt, Artificial Sequence
  source: /note="Description of Artificial Sequence: Synthetic oligonucleotide"
aggcuuagguugaacuccgaguu

SEQ ID NO: 819 - RNA, 23 nt, Artificial Sequence
  source: /note="Description of Artificial Sequence: Synthetic oligonucleotide"
acaauaggaacuguuccucagag

SEQ ID NO: 820 - RNA, 23 nt, Artificial Sequence
  source: /note="Description of Artificial Sequence: Synthetic oligonucleotide"
uuaaaagcccuguauaaugauga

SEQ ID NO: 821 - RNA, 23 nt, Artificial Sequence
  source: /note="Description of Artificial Sequence: Synthetic oligonucleotide"
agggacuaaaacuuuuuaucaaa

SEQ ID NO: 822 - RNA, 23 nt, Artificial Sequence
  source: /note="Description of Artificial Sequence: Synthetic oligonucleotide"
uucucuguuaccagcuacuacag

SEQ ID NO: 823 - RNA, 23 nt, Artificial Sequence
  source: /note="Description of Artificial Sequence: Synthetic oligonucleotide"
auccugucccuucucuguuacca

SEQ ID NO: 824 - RNA, 23 nt, Artificial Sequence
  source: /note="Description of Artificial Sequence: Synthetic oligonucleotide"
gcuuugugagucuagcaucugag

SEQ ID NO: 825 - RNA, 23 nt, Artificial Sequence
  source: /note="Description of Artificial Sequence: Synthetic oligonucleotide"
cugaucagugaagugguucgauc

SEQ ID NO: 826 - RNA, 23 nt, Artificial Sequence
  source: /note="Description of Artificial Sequence: Synthetic oligonucleotide"
cuccucugguauggaaacucggg

SEQ ID NO: 827 - RNA, 23 nt, Artificial Sequence
  source: /note="Description of Artificial Sequence: Synthetic oligonucleotide"
acagaguccuuggucaagcuaag

SEQ ID NO: 828 - RNA, 23 nt, Artificial Sequence
  source: /note="Description of Artificial Sequence: Synthetic oligonucleotide"
aguucaaccuaagccuuuuggcu

SEQ ID NO: 829 - RNA, 23 nt, Artificial Sequence
  source: /note="Description of Artificial Sequence: Synthetic oligonucleotide"
gcugacagaacuacggagagugc

SEQ ID NO: 830 - RNA, 23 nt, Artificial Sequence
  source: /note="Description of Artificial Sequence: Synthetic oligonucleotide"
cccuccaugugugcuugucacac

SEQ ID NO: 831 - RNA, 23 nt, Artificial Sequence
  source: /note="Description of Artificial Sequence: Synthetic oligonucleotide"
accgaacguacccaguuugaaau

SEQ ID NO: 832 - RNA, 23 nt, Artificial Sequence
  source: /note="Description of Artificial Sequence: Synthetic oligonucleotide"
ugauaccacaucauaccagucuc

SEQ ID NO: 833 - RNA, 23 nt, Artificial Sequence
  source: /note="Description of Artificial Sequence: Synthetic oligonucleotide"
ugcugcaugugacaaaguuuaug

SEQ ID NO: 834 - RNA, 23 nt, Artificial Sequence
  source: /note="Description of Artificial Sequence: Synthetic oligonucleotide"
uauucacuccuguucgcaguuuc

SEQ ID NO: 835 - RNA, 23 nt, Artificial Sequence
  source: /note="Description of Artificial Sequence: Synthetic oligonucleotide"
uccugucccuucucuguuaccag

SEQ ID NO: 836 - RNA, 23 nt, Artificial Sequence
  source: /note="Description of Artificial Sequence: Synthetic oligonucleotide"
caucugagaaugggacucaauuu

SEQ ID NO: 837 - RNA, 23 nt, Artificial Sequence
  source: /note="Description of Artificial Sequence: Synthetic oligonucleotide"
cuucagaagaugagauccucauu

SEQ ID NO: 838 - RNA, 23 nt, Artificial Sequence
  source: /note="Description of Artificial Sequence: Synthetic oligonucleotide"
agccacugaaggcucucgauacc

SEQ ID NO: 839 - RNA, 23 nt, Artificial Sequence
  source: /note="Description of Artificial Sequence: Synthetic oligonucleotide"
gcgagucugugauuguagcuaug

SEQ ID NO: 840 - RNA, 23 nt, Artificial Sequence
  source: /note="Description of Artificial Sequence: Synthetic oligonucleotide"
ugucauggcauuugauccaugag

SEQ ID NO: 841 - RNA, 23 nt, Artificial Sequence
  source: /note="Description of Artificial Sequence: Synthetic oligonucleotide"
gcacggcauccucuauguguugg

SEQ ID NO: 842 - RNA, 23 nt, Artificial Sequence
  source: /note="Description of Artificial Sequence: Synthetic oligonucleotide"
caugagcgagauugcuaauggcc

SEQ ID NO: 843 - RNA, 23 nt, Artificial Sequence
  source: /note="Description of Artificial Sequence: Synthetic oligonucleotide"
gacgcugacagaacuacggagag

SEQ ID NO: 844 - RNA, 23 nt, Artificial Sequence
  source: /note="Description of Artificial Sequence: Synthetic oligonucleotide"
gaaagcaggucacauacuccaag

SEQ ID NO: 845 - RNA, 23 nt, Artificial Sequence
  source: /note="Description of Artificial Sequence: Synthetic oligonucleotide"
uuccaguuguuagugacuaucug

SEQ ID NO: 846 - RNA, 23 nt, Artificial Sequence
  source: /note="Description of Artificial Sequence: Synthetic oligonucleotide"
gaucagugaagugguucgaucuc

SEQ ID NO: 847 - RNA, 23 nt, Artificial Sequence
  source: /note="Description of Artificial Sequence: Synthetic oligonucleotide"
ugaucagugaagugguucgaucu

SEQ ID NO: 848 - RNA, 23 nt, Artificial Sequence
  source: /note="Description of Artificial Sequence: Synthetic oligonucleotide"
cuccaugugugcuugucacacuc

SEQ ID NO: 849 - RNA, 23 nt, Artificial Sequence
  source: /note="Description of Artificial Sequence: Synthetic oligonucleotide"
auuuucagcaucugugauacaga

SEQ ID NO: 850 - RNA, 23 nt, Artificial Sequence
  source: /note="Description of Artificial Sequence: Synthetic oligonucleotide"
ugaaggcucucgauaccagauuu

SEQ ID NO: 851 - RNA, 23 nt, Artificial Sequence
  source: /note="Description of Artificial Sequence: Synthetic oligonucleotide"
ccuagaugacuucuuuccaccuc

SEQ ID NO: 852 - RNA, 23 nt, Artificial Sequence
  source: /note="Description of Artificial Sequence: Synthetic oligonucleotide"
uaguuaacagcuauacucgugug

SEQ ID NO: 853 - RNA, 23 nt, Artificial Sequence
  source: /note="Description of Artificial Sequence: Synthetic oligonucleotide"
uguccaaccucaaaggaauagcc

SEQ ID NO: 854 - RNA, 23 nt, Artificial Sequence
  source: /note="Description of Artificial Sequence: Synthetic oligonucleotide"
gauugcuaauggccaaaagaguc

SEQ ID NO: 855 - RNA, 23 nt, Artificial Sequence
  source: /note="Description of Artificial Sequence: Synthetic oligonucleotide"
aucugcuguccaaccucaaagga

SEQ ID NO: 856 - RNA, 23 nt, Artificial Sequence
  source: /note="Description of Artificial Sequence: Synthetic oligonucleotide"
caccgaacguacccaguuugaaa

SEQ ID NO: 857 - RNA, 23 nt, Artificial Sequence
  source: /note="Description of Artificial Sequence: Synthetic oligonucleotide"
ggaaguagacucagauauacaaa

SEQ ID NO: 858 - RNA, 23 nt, Artificial Sequence
  source: /note="Description of Artificial Sequence: Synthetic oligonucleotide"
cagcucauuccaguuguuaguga

SEQ ID NO: 859 - RNA, 23 nt, Artificial Sequence
  source: /note="Description of Artificial Sequence: Synthetic oligonucleotide"
aucagugaagugguucgaucucu

SEQ ID NO: 860 - RNA, 23 nt, Artificial Sequence
  source: /note="Description of Artificial Sequence: Synthetic oligonucleotide"
gcgagauugcuaauggccaaaag

SEQ ID NO: 861 - RNA, 23 nt, Artificial Sequence
  source: /note="Description of Artificial Sequence: Synthetic oligonucleotide"
cagaguccuuggucaagcuaagu

SEQ ID NO: 862 - RNA, 23 nt, Artificial Sequence
  source: /note="Description of Artificial Sequence: Synthetic oligonucleotide"
aggcucucgauaccagauuugga

SEQ ID NO: 863 - RNA, 23 nt, Artificial Sequence
  source: /note="Description of Artificial Sequence: Synthetic oligonucleotide"
ugcaugugacaaaguuuauggaa

SEQ ID NO: 864 - RNA, 23 nt, Artificial Sequence
  source: /note="Description of Artificial Sequence: Synthetic oligonucleotide"
ccuccucugguauggaaacucgg

SEQ ID NO: 865 - RNA, 23 nt, Artificial Sequence
  source: /note="Description of Artificial Sequence: Synthetic oligonucleotide"
uccaaccucaaaggaauagccca

SEQ ID NO: 866 - RNA, 23 nt, Artificial Sequence
  source: /note="Description of Artificial Sequence: Synthetic oligonucleotide"
auugcuaauggccaaaagagucc

SEQ ID NO: 867 - RNA, 23 nt, Artificial Sequence
  source: /note="Description of Artificial Sequence: Synthetic oligonucleotide"
uuccuaugcccguguaaagugug

SEQ ID NO: 868 - RNA, 23 nt, Artificial Sequence
  source: /note="Description of Artificial Sequence: Synthetic oligonucleotide"
cugacgcugacagaacuacggag

SEQ ID NO: 869 - RNA, 23 nt, Artificial Sequence
  source: /note="Description of Artificial Sequence: Synthetic oligonucleotide"
agacucagauauacaaaaccuca

SEQ ID NO: 870 - RNA, 23 nt, Artificial Sequence
  source: /note="Description of Artificial Sequence: Synthetic oligonucleotide"
acuucuuuccaccucaagauguc

SEQ ID NO: 871 - RNA, 23 nt, Artificial Sequence
  source: /note="Description of Artificial Sequence: Synthetic oligonucleotide"
gacagcgagucugugauuguagc

SEQ ID NO: 872 - RNA, 23 nt, Artificial Sequence
  source: /note="Description of Artificial Sequence: Synthetic oligonucleotide"
guagacucagauauacaaaaccu

SEQ ID NO: 873 - RNA, 23 nt, Artificial Sequence
  source: /note="Description of Artificial Sequence: Synthetic oligonucleotide"
cuuugugagucuagcaucugaga

SEQ ID NO: 874 - RNA, 23 nt, Artificial Sequence
  source: /note="Description of Artificial Sequence: Synthetic oligonucleotide"
gguugauauucacuccuguucgc

SEQ ID NO: 875 - RNA, 23 nt, Artificial Sequence
  source: /note="Description of Artificial Sequence: Synthetic oligonucleotide"
uguagcuacucagucuagucggg

SEQ ID NO: 876 - RNA, 23 nt, Artificial Sequence
  source: /note="Description of Artificial Sequence: Synthetic oligonucleotide"
caccugugucuccagucaauucc

SEQ ID NO: 877 - RNA, 23 nt, Artificial Sequence
  source: /note="Description of Artificial Sequence: Synthetic oligonucleotide"
gcagggaacaugcacuauguugg

SEQ ID NO: 878 - RNA, 23 nt, Artificial Sequence
  source: /note="Description of Artificial Sequence: Synthetic oligonucleotide"
gaagccauugcaguacaaccugg

SEQ ID NO: 879 - RNA, 23 nt, Artificial Sequence
  source: /note="Description of Artificial Sequence: Synthetic oligonucleotide"
gaugcaagguucccuaccaaaca

SEQ ID NO: 880 - RNA, 23 nt, Artificial Sequence
  source: /note="Description of Artificial Sequence: Synthetic oligonucleotide"
auacagauguguggaguaaugcu

SEQ ID NO: 881 - RNA, 23 nt, Artificial Sequence
  source: /note="Description of Artificial Sequence: Synthetic oligonucleotide"
gugcugcaugugacaaaguuuau

SEQ ID NO: 882 - RNA, 23 nt, Artificial Sequence
  source: /note="Description of Artificial Sequence: Synthetic oligonucleotide"
cugugcugcaugugacaaaguuu

SEQ ID NO: 883 - RNA, 23 nt, Artificial Sequence
  source: /note="Description of Artificial Sequence: Synthetic oligonucleotide"
gcugcaugugacaaaguuuaugg

SEQ ID NO: 884 - RNA, 23 nt, Artificial Sequence
  source: /note="Description of Artificial Sequence: Synthetic oligonucleotide"
cuaguuaacagcuauacucgugu

SEQ ID NO: 885 - RNA, 23 nt, Artificial Sequence
  source: /note="Description of Artificial Sequence: Synthetic oligonucleotide"
gagcucggaguucaaccuaagcc

SEQ ID NO: 886 - RNA, 23 nt, Artificial Sequence
  source: /note="Description of Artificial Sequence: Synthetic oligonucleotide"
ucauccugaucagugaagugguu

SEQ ID NO: 887 - RNA, 23 nt, Artificial Sequence
  source: /note="Description of Artificial Sequence: Synthetic oligonucleotide"
uacagucagcuuugugagucuag

SEQ ID NO: 888 - RNA, 23 nt, Artificial Sequence
  source: /note="Description of Artificial Sequence: Synthetic oligonucleotide"
uugauauucacuccuguucgcag

SEQ ID NO: 889 - RNA, 23 nt, Artificial Sequence
  source: /note="Description of Artificial Sequence: Synthetic oligonucleotide"
uguugaugcacucuccuagucuc

SEQ ID NO: 890 - RNA, 23 nt, Artificial Sequence
  source: /note="Description of Artificial Sequence: Synthetic oligonucleotide"
cucagauauacaaaaccucaguc

SEQ ID NO: 891 - RNA, 23 nt, Artificial Sequence
  source: /note="Description of Artificial Sequence: Synthetic oligonucleotide"
cuuggcaugagcgagauugcuaa

SEQ ID NO: 892 - RNA, 23 nt, Artificial Sequence
  source: /note="Description of Artificial Sequence: Synthetic oligonucleotide"
gaacagguggaugugaaccuuuu

SEQ ID NO: 893 - RNA, 23 nt, Artificial Sequence
  source: /note="Description of Artificial Sequence: Synthetic oligonucleotide"
augagcucggaguucaaccuaag

SEQ ID NO: 894 - RNA, 23 nt, Artificial Sequence
  source: /note="Description of Artificial Sequence: Synthetic oligonucleotide"
ucugucccuuuguaucuucugca

SEQ ID NO: 895 - RNA, 23 nt, Artificial Sequence
  source: /note="Description of Artificial Sequence: Synthetic oligonucleotide"
uuacuccucaugguagauguuca

SEQ ID NO: 896 - RNA, 23 nt, Artificial Sequence
  source: /note="Description of Artificial Sequence: Synthetic oligonucleotide"
gaaggcucucgauaccagauuug

SEQ ID NO: 897 - RNA, 23 nt, Artificial Sequence
  source: /note="Description of Artificial Sequence: Synthetic oligonucleotide"
caaaucugguaucgagagccuuc

SEQ ID NO: 898 - RNA, 23 nt, Artificial Sequence
  source: /note="Description of Artificial Sequence: Synthetic oligonucleotide"
ugcuguccaaccucaaaggaaua

SEQ ID NO: 899 - RNA, 23 nt, Artificial Sequence
  source: /note="Description of Artificial Sequence: Synthetic oligonucleotide"
aucugagaaugggacucaauuuu

SEQ ID NO: 900 - RNA, 23 nt, Artificial Sequence
  source: /note="Description of Artificial Sequence: Synthetic oligonucleotide"
cccgucauccugaucagugaagu

SEQ ID NO: 901 - RNA, 23 nt, Artificial Sequence
  source: /note="Description of Artificial Sequence: Synthetic oligonucleotide"
cccaaaggugucucugagcuaug

SEQ ID NO: 902 - RNA, 23 nt, Artificial Sequence
  source: /note="Description of Artificial Sequence: Synthetic oligonucleotide"
agcuacuacaggugcucuuauca

SEQ ID NO: 903 - RNA, 23 nt, Artificial Sequence
  source: /note="Description of Artificial Sequence: Synthetic oligonucleotide"
uuggcaugagcgagauugcuaau

SEQ ID NO: 904 - RNA, 23 nt, Artificial Sequence
  source: /note="Description of Artificial Sequence: Synthetic oligonucleotide"
aauggcaggagugcuuugcaaug

SEQ ID NO: 905 - RNA, 23 nt, Artificial Sequence
  source: /note="Description of Artificial Sequence: Synthetic oligonucleotide"
cucucgauaccagauuuggaaga

SEQ ID NO: 906 - RNA, 23 nt, Artificial Sequence
  source: /note="Description of Artificial Sequence: Synthetic oligonucleotide"
ccuaguuaacagcuauacucgug

SEQ ID NO: 907 - RNA, 23 nt, Artificial Sequence
  source: /note="Description of Artificial Sequence: Synthetic oligonucleotide"
acuccucaugguagauguucaua

SEQ ID NO: 908 - RNA, 23 nt, Artificial Sequence
  source: /note="Description of Artificial Sequence: Synthetic oligonucleotide"
auauucacuccuguucgcaguuu

SEQ ID NO: 909 - RNA, 23 nt, Artificial Sequence
  source: /note="Description of Artificial Sequence: Synthetic oligonucleotide"
ucagauauacaaaaccucaguca

SEQ ID NO: 910 - RNA, 23 nt, Artificial Sequence
  source: /note="Description of Artificial Sequence: Synthetic oligonucleotide"
gaguucaaccuaagccuuuuggc

SEQ ID NO: 911 - RNA, 23 nt, Artificial Sequence
  source: /note="Description of Artificial Sequence: Synthetic oligonucleotide"
acgcugacagaacuacggagagu

SEQ ID NO: 912 - RNA, 23 nt, Artificial Sequence
  source: /note="Description of Artificial Sequence: Synthetic oligonucleotide"
gucugcacauguacccuucagga

SEQ ID NO: 913 - RNA, 23 nt, Artificial Sequence
  source: /note="Description of Artificial Sequence: Synthetic oligonucleotide"
cgucauccugaucagugaagugg

SEQ ID NO: 914 - RNA, 23 nt, Artificial Sequence
  source: /note="Description of Artificial Sequence: Synthetic oligonucleotide"
uggcaugagcgagauugcuaaug

SEQ ID NO: 915 - RNA, 23 nt, Artificial Sequence
  source: /note="Description of Artificial Sequence: Synthetic oligonucleotide"
ugcagggaacaugcacuauguug

SEQ ID NO: 916 - RNA, 23 nt, Artificial Sequence
  source: /note="Description of Artificial Sequence: Synthetic oligonucleotide"
uauuguucuuucucguauucagg

SEQ ID NO: 917 - RNA, 23 nt, Artificial Sequence
  source: /note="Description of Artificial Sequence: Synthetic oligonucleotide"
cgugcagauaagaaugcuauuca

SEQ ID NO: 918 - RNA, 23 nt, Artificial Sequence
  source: /note="Description of Artificial Sequence: Synthetic oligonucleotide"
agcaaacucuauaaaguuccucu

SEQ ID NO: 919 - RNA, 23 nt, Artificial Sequence
  source: /note="Description of Artificial Sequence: Synthetic oligonucleotide"
ugaagauauuguucuuucucgua

SEQ ID NO: 920 - RNA, 23 nt, Artificial Sequence
  source: /note="Description of Artificial Sequence: Synthetic oligonucleotide"
accugaaacuucucaugcaugag

SEQ ID NO: 921 - RNA, 23 nt, Artificial Sequence
  source: /note="Description of Artificial Sequence: Synthetic oligonucleotide"
uaagaaugcuauucauaaucaca

SEQ ID NO: 922 - RNA, 23 nt, Artificial Sequence
  source: /note="Description of Artificial Sequence: Synthetic oligonucleotide"
ccucaacaaaguuaucaaagcuu

SEQ ID NO: 923 - RNA, 23 nt, Artificial Sequence
  source: /note="Description of Artificial Sequence: Synthetic oligonucleotide"
augaacugacguuacaucauaca

SEQ ID NO: 924 - RNA, 23 nt, Artificial Sequence
  source: /note="Description of Artificial Sequence: Synthetic oligonucleotide"
uaccugaaauccugcuuuagucg

SEQ ID NO: 925 - RNA, 23 nt, Artificial Sequence
  source: /note="Description of Artificial Sequence: Synthetic oligonucleotide"
aucauugucugacaauaugugaa

SEQ ID NO: 926 - RNA, 23 nt, Artificial Sequence
  source: /note="Description of Artificial Sequence: Synthetic oligonucleotide"
accagucguacucaguuugaaga

SEQ ID NO: 927 - RNA, 23 nt, Artificial Sequence
  source: /note="Description of Artificial Sequence: Synthetic oligonucleotide"
guagcuacucagucuagucgggc

SEQ ID NO: 928 - RNA, 23 nt, Artificial Sequence
  source: /note="Description of Artificial Sequence: Synthetic oligonucleotide"
uguuugaaccucuuguuauaaaa

SEQ ID NO: 929 - RNA, 23 nt, Artificial Sequence
  source: /note="Description of Artificial Sequence: Synthetic oligonucleotide"
uuguuugaaccucuuguuauaaa

SEQ ID NO: 930 - RNA, 23 nt, Artificial Sequence
  source: /note="Description of Artificial Sequence: Synthetic oligonucleotide"
aucuugaacuacaucgaucaugg

SEQ ID NO: 931 - RNA, 23 nt, Artificial Sequence
  source: /note="Description of Artificial Sequence: Synthetic oligonucleotide"
auuguucuuucucguauucagga

SEQ ID NO: 932 - RNA, 23 nt, Artificial Sequence
  source: /note="Description of Artificial Sequence: Synthetic oligonucleotide"
gugcagcuucuagacaaucugau

SEQ ID NO: 933 - RNA, 23 nt, Artificial Sequence
  source: /note="Description of Artificial Sequence: Synthetic oligonucleotide"
uuuguuugaaccucuuguuauaa

SEQ ID NO: 934 - RNA, 23 nt, Artificial Sequence
  source: /note="Description of Artificial Sequence: Synthetic oligonucleotide"
gugaaaaccuuucaacuccaacc

SEQ ID NO: 935 - RNA, 23 nt, Artificial Sequence
  source: /note="Description of Artificial Sequence: Synthetic oligonucleotide"
gaacugacguuacaucauacaca

SEQ ID NO: 936 - RNA, 23 nt, Artificial Sequence
  source: /note="Description of Artificial Sequence: Synthetic oligonucleotide"
auccugcuuuagucgagaaccaa

SEQ ID NO: 937 - RNA, 23 nt, Artificial Sequence
  source: /note="Description of Artificial Sequence: Synthetic oligonucleotide"
ucuggauucagaucagguguuua

SEQ ID NO: 938 - RNA, 23 nt, Artificial Sequence
  source: /note="Description of Artificial Sequence: Synthetic oligonucleotide"
ggcugcugacuuguuuacgaaau

SEQ ID NO: 939 - RNA, 23 nt, Artificial Sequence
  source: /note="Description of Artificial Sequence: Synthetic oligonucleotide"
ccugguguugaugcacucuccua

SEQ ID NO: 940 - RNA, 23 nt, Artificial Sequence
  source: /note="Description of Artificial Sequence: Synthetic oligonucleotide"
aacagaucauuggaauuccuaaa

SEQ ID NO: 941 - RNA, 23 nt, Artificial Sequence
  source: /note="Description of Artificial Sequence: Synthetic oligonucleotide"
uuguucuuucucguauucaggag

SEQ ID NO: 942 - RNA, 23 nt, Artificial Sequence
  source: /note="Description of Artificial Sequence: Synthetic oligonucleotide"
gcagcuucuagacaaucugauac

SEQ ID NO: 943 - RNA, 23 nt, Artificial Sequence
  source: /note="Description of Artificial Sequence: Synthetic oligonucleotide"
acauuuucaagguuucuauuaca

SEQ ID NO: 944 - RNA, 23 nt, Artificial Sequence
  source: /note="Description of Artificial Sequence: Synthetic oligonucleotide"
agcuucuagacaaucugauaccu

SEQ ID NO: 945 - RNA, 23 nt, Artificial Sequence
  source: /note="Description of Artificial Sequence: Synthetic oligonucleotide"
aaagcuuuaaaacaguacacgac

SEQ ID NO: 946 - RNA, 23 nt, Artificial Sequence
  source: /note="Description of Artificial Sequence: Synthetic oligonucleotide"
aagcuuugauggauucuaaucuu

SEQ ID NO: 947 - RNA, 23 nt, Artificial Sequence
  source: /note="Description of Artificial Sequence: Synthetic oligonucleotide"
aacugacguuacaucauacacag

SEQ ID NO: 948 - RNA, 23 nt, Artificial Sequence
  source: /note="Description of Artificial Sequence: Synthetic oligonucleotide"
uccugcuuuagucgagaaccaau

SEQ ID NO: 949 - RNA, 23 nt, Artificial Sequence
  source: /note="Description of Artificial Sequence: Synthetic oligonucleotide"
uauguucgucacuccaaacacaa

SEQ ID NO: 950 - RNA, 23 nt, Artificial Sequence
  source: /note="Description of Artificial Sequence: Synthetic oligonucleotide"
gcugacuuguuuacgaaaugucc

SEQ ID NO: 951 - RNA, 23 nt, Artificial Sequence
  source: /note="Description of Artificial Sequence: Synthetic oligonucleotide"
ugguguugaugcacucuccuagu

SEQ ID NO: 952 - RNA, 23 nt, Artificial Sequence
  source: /note="Description of Artificial Sequence: Synthetic oligonucleotide"
uggauucuaaucuuccaagguua

SEQ ID NO: 953 - RNA, 23 nt, Artificial Sequence
  source: /note="Description of Artificial Sequence: Synthetic oligonucleotide"
gucucguugugaaaaccuuucaa

SEQ ID NO: 954 - RNA, 23 nt, Artificial Sequence
  source: /note="Description of Artificial Sequence: Synthetic oligonucleotide"
cuucuagacaaucugauaccuca

SEQ ID NO: 955 - RNA, 23 nt, Artificial Sequence
  source: /note="Description of Artificial Sequence: Synthetic oligonucleotide"
cucaacaaaguuaucaaagcuuu

SEQ ID NO: 956 - RNA, 23 nt, Artificial Sequence
  source: /note="Description of Artificial Sequence: Synthetic oligonucleotide"
cucagguccuguuacaacaagua

SEQ ID NO: 957 - RNA, 23 nt, Artificial Sequence
  source: /note="Description of Artificial Sequence: Synthetic oligonucleotide"
ugguucaguuacggguuaauuac

SEQ ID NO: 958 - RNA, 23 nt, Artificial Sequence
  source: /note="Description of Artificial Sequence: Synthetic oligonucleotide"
gaccagucguacucaguuugaag

SEQ ID NO: 959 - RNA, 23 nt, Artificial Sequence
  source: /note="Description of Artificial Sequence: Synthetic oligonucleotide"
guucugaaauuguguuagacggu

SEQ ID NO: 960 - RNA, 23 nt, Artificial Sequence
  source: /note="Description of Artificial Sequence: Synthetic oligonucleotide"
auggcaacuguuuguguucaaca

SEQ ID NO: 961 - RNA, 23 nt, Artificial Sequence
  source: /note="Description of Artificial Sequence: Synthetic oligonucleotide"
uguucgucacuccaaacacaaug

SEQ ID NO: 962 - RNA, 23 nt, Artificial Sequence
  source: /note="Description of Artificial Sequence: Synthetic oligonucleotide"
cgcugacauuuccguuguacaug

SEQ ID NO: 963 - RNA, 23 nt, Artificial Sequence
  source: /note="Description of Artificial Sequence: Synthetic oligonucleotide"
agccacugccaagugcccuuuau

SEQ ID NO: 964 - RNA, 23 nt, Artificial Sequence
  source: /note="Description of Artificial Sequence: Synthetic oligonucleotide"
uccagguuuaugaacugacguua

SEQ ID NO: 965 - RNA, 23 nt, Artificial Sequence
  source: /note="Description of Artificial Sequence: Synthetic oligonucleotide"
ggauucuaaucuuccaagguuac

SEQ ID NO: 966 - RNA, 23 nt, Artificial Sequence
  source: /note="Description of Artificial Sequence: Synthetic oligonucleotide"
aacaaguaaauccucaucacugg

SEQ ID NO: 967 - RNA, 23 nt, Artificial Sequence
  source: /note="Description of Artificial Sequence: Synthetic oligonucleotide"
cuuugauggauucuaaucuucca

SEQ ID NO: 968 - RNA, 23 nt, Artificial Sequence
  source: /note="Description of Artificial Sequence: Synthetic oligonucleotide"
uccuucauaccucaaacugcaug

SEQ ID NO: 969 - RNA, 23 nt, Artificial Sequence
  source: /note="Description of Artificial Sequence: Synthetic oligonucleotide"
uuuauuggcuuuguauugaaaca

SEQ ID NO: 970 - RNA, 23 nt, Artificial Sequence
  source: /note="Description of Artificial Sequence: Synthetic oligonucleotide"
gcugcugacuuguuuacgaaaug

SEQ ID NO: 971 - RNA, 23 nt, Artificial Sequence
  source: /note="Description of Artificial Sequence: Synthetic oligonucleotide"
uucugaaauuguguuagacggua

SEQ ID NO: 972 - RNA, 23 nt, Artificial Sequence
  source: /note="Description of Artificial Sequence: Synthetic oligonucleotide"
uauucauaaucacauucguuugu

SEQ ID NO: 973 - RNA, 23 nt, Artificial Sequence
  source: /note="Description of Artificial Sequence: Synthetic oligonucleotide"
ggcaauucagucucguugugaaa

SEQ ID NO: 974 - RNA, 23 nt, Artificial Sequence
  source: /note="Description of Artificial Sequence: Synthetic oligonucleotide"
guccagguuuaugaacugacguu

SEQ ID NO: 975 - RNA, 23 nt, Artificial Sequence
  source: /note="Description of Artificial Sequence: Synthetic oligonucleotide"
guccuccagggauugguaugugg

SEQ ID NO: 976 - RNA, 23 nt, Artificial Sequence
  source: /note="Description of Artificial Sequence: Synthetic oligonucleotide"
ucuuucuucagcaaacucuauaa

SEQ ID NO: 977 - RNA, 23 nt, Artificial Sequence
  source: /note="Description of Artificial Sequence: Synthetic oligonucleotide"
gcuguucccaaaauuauggcuuc

SEQ ID NO: 978 - RNA, 23 nt, Artificial Sequence
  source: /note="Description of Artificial Sequence: Synthetic oligonucleotide"
aguuucuaucaucuuccuucaua

SEQ ID NO: 979 - RNA, 23 nt, Artificial Sequence
  source: /note="Description of Artificial Sequence: Synthetic oligonucleotide"
gucuuuaaggaguucaucuaccg

SEQ ID NO: 980 - RNA, 23 nt, Artificial Sequence
  source: /note="Description of Artificial Sequence: Synthetic oligonucleotide"
acuguuuguguucaacaauuguu

SEQ ID NO: 981 - RNA, 23 nt, Artificial Sequence
  source: /note="Description of Artificial Sequence: Synthetic oligonucleotide"
gcacuguucaacuguggauaucg

SEQ ID NO: 982 - RNA, 23 nt, Artificial Sequence
  source: /note="Description of Artificial Sequence: Synthetic oligonucleotide"
uuuaacguaacucuuucuaugcc

SEQ ID NO: 983 - RNA, 23 nt, Artificial Sequence
  source: /note="Description of Artificial Sequence: Synthetic oligonucleotide"
acucugaggaacaguuccuauug

SEQ ID NO: 984 - RNA, 23 nt, Artificial Sequence
  source: /note="Description of Artificial Sequence: Synthetic oligonucleotide"
auucauaaucacauucguuuguu

SEQ ID NO: 985 - RNA, 23 nt, Artificial Sequence
  source: /note="Description of Artificial Sequence: Synthetic oligonucleotide"
ugauggauucuaaucuuccaagg

SEQ ID NO: 986 - RNA, 23 nt, Artificial Sequence
  source: /note="Description of Artificial Sequence: Synthetic oligonucleotide"
uaugaacugacguuacaucauac

SEQ ID NO: 987 - RNA, 23 nt, Artificial Sequence
  source: /note="Description of Artificial Sequence: Synthetic oligonucleotide"
acucuauaaaguuccucuugaca

SEQ ID NO: 988 - RNA, 23 nt, Artificial Sequence
  source: /note="Description of Artificial Sequence: Synthetic oligonucleotide"
augcuauucauaaucacauucgu

SEQ ID NO: 989 - RNA, 23 nt, Artificial Sequence
  source: /note="Description of Artificial Sequence: Synthetic oligonucleotide"
uggcuacuaaaugugcucuuagg

SEQ ID NO: 990 - RNA, 23 nt, Artificial Sequence
  source: /note="Description of Artificial Sequence: Synthetic oligonucleotide"
aagcuuuaaaacaguacacgacu

SEQ ID NO: 991 - RNA, 23 nt, Artificial Sequence
  source: /note="Description of Artificial Sequence: Synthetic oligonucleotide"
ccagguuuaugaacugacguuac

SEQ ID NO: 992 - RNA, 23 nt, Artificial Sequence
  source: /note="Description of Artificial Sequence: Synthetic oligonucleotide"
guucaacaauuguugaagacucu

SEQ ID NO: 993 - RNA, 23 nt, Artificial Sequence
  source: /note="Description of Artificial Sequence: Synthetic oligonucleotide"
cagcaacauacuuucuauugcca

SEQ ID NO: 994 - RNA, 23 nt, Artificial Sequence
  source: /note="Description of Artificial Sequence: Synthetic oligonucleotide"
acauuuccguuguacauguuccu

SEQ ID NO: 995 - RNA, 23 nt, Artificial Sequence
  source: /note="Description of Artificial Sequence: Synthetic oligonucleotide"
uucuccgucagcacaauaaccag

SEQ ID NO: 996 - RNA, 23 nt, Artificial Sequence
  source: /note="Description of Artificial Sequence: Synthetic oligonucleotide"
gcugguucaguuacggguuaauu

SEQ ID NO: 997 - RNA, 23 nt, Artificial Sequence
  source: /note="Description of Artificial Sequence: Synthetic oligonucleotide"
gauucuaaucuuccaagguuaca

SEQ ID NO: 998 - RNA, 23 nt, Artificial Sequence
  source: /note="Description of Artificial Sequence: Synthetic oligonucleotide"
gggaguauuguggaacuuauagc

SEQ ID NO: 999 - RNA, 23 nt, Artificial Sequence
  source: /note="Description of Artificial Sequence: Synthetic oligonucleotide"
aagauauuguucuuucucguauu

SEQ ID NO: 1000 - RNA, 23 nt, Artificial Sequence
  source: /note="Description of Artificial Sequence: Synthetic oligonucleotide"
uucuagacaaucugauaccucag

SEQ ID NO: 1001 - RNA, 23 nt, Artificial Sequence
  source: /note="Description of Artificial Sequence: Synthetic oligonucleotide"
uccgccuuuuaucugcuucguuu

SEQ ID NO: 1002 - RNA, 23 nt, Artificial Sequence
  source: /note="Description of Artificial Sequence: Synthetic oligonucleotide"
cuuaugaacgcuaucauucaaaa

SEQ ID NO: 1003 - RNA, 23 nt, Artificial Sequence
  source: /note="Description of Artificial Sequence: Synthetic oligonucleotide"
ucugaaauuguguuagacgguac

SEQ ID NO: 1004 - RNA, 23 nt, Artificial Sequence
  source: /note="Description of Artificial Sequence: Synthetic oligonucleotide"
acaucuucaagucuggaauguuc

SEQ ID NO: 1005 - RNA, 23 nt, Artificial Sequence
  source: /note="Description of Artificial Sequence: Synthetic oligonucleotide"
uuuccguuguacauguuccuguu

SEQ ID NO: 1006 - RNA, 23 nt, Artificial Sequence
  source: /note="Description of Artificial Sequence: Synthetic oligonucleotide"
cagcuucuagacaaucugauacc

SEQ ID NO: 1007 - RNA, 23 nt, Artificial Sequence
  source: /note="Description of Artificial Sequence: Synthetic oligonucleotide"
gguucaguuacggguuaauuacu

SEQ ID NO: 1008 - RNA, 23 nt, Artificial Sequence
  source: /note="Description of Artificial Sequence: Synthetic oligonucleotide"
accaugcaagacucacuuagucc

SEQ ID NO: 1009 - RNA, 23 nt, Artificial Sequence
  source: /note="Description of Artificial Sequence: Synthetic oligonucleotide"
aggaugacucugaaucgagaucg

SEQ ID NO: 1010 - RNA, 23 nt, Artificial Sequence
  source: /note="Description of Artificial Sequence: Synthetic oligonucleotide"
agaggcuauaaccuacuaccaag

SEQ ID NO: 1011 - RNA, 23 nt, Artificial Sequence
  source: /note="Description of Artificial Sequence: Synthetic oligonucleotide"
ugacucugaaucgagaucggaug

SEQ ID NO: 1012 - RNA, 23 nt, Artificial Sequence
  source: /note="Description of Artificial Sequence: Synthetic oligonucleotide"
uaaccuacuaccaagcauaacag

SEQ ID NO: 1013 - RNA, 23 nt, Artificial Sequence
  source: /note="Description of Artificial Sequence: Synthetic oligonucleotide"
acucugaaucgagaucggauguc

SEQ ID NO: 1014 - RNA, 23 nt, Artificial Sequence
  source: /note="Description of Artificial Sequence: Synthetic oligonucleotide"
ucagguccuguuacaacaaguaa

SEQ ID NO: 1015 - RNA, 23 nt, Artificial Sequence
  source: /note="Description of Artificial Sequence: Synthetic oligonucleotide"
ugacagcaguguugauaaauuug

SEQ ID NO: 1016 - RNA, 23 nt, Artificial Sequence
  source: /note="Description of Artificial Sequence: Synthetic oligonucleotide"
cagguccuguuacaacaaguaaa

SEQ ID NO: 1017 - RNA, 23 nt, Artificial Sequence
  source: /note="Description of Artificial Sequence: Synthetic oligonucleotide"
ucuugaacuacaucgaucaugga

SEQ ID NO: 1018 - RNA, 23 nt, Artificial Sequence
  source: /note="Description of Artificial Sequence: Synthetic oligonucleotide"
gaacucggaguucaaccuaagcc

SEQ ID NO: 1019 - RNA, 23 nt, Artificial Sequence
  source: /note="Description of Artificial Sequence: Synthetic oligonucleotide"
gacucugaggaacaguuccuauu

SEQ ID NO: 1020 - RNA, 23 nt, Artificial Sequence
  source: /note="Description of Artificial Sequence: Synthetic oligonucleotide"
aacucggaguucaaccuaagccu

SEQ ID NO: 1021 - RNA, 23 nt, Artificial Sequence
  source: /note="Description of Artificial Sequence: Synthetic oligonucleotide"
cucugaggaacaguuccuauugg

SEQ ID NO: 1022 - RNA, 23 nt, Artificial Sequence
  source: /note="Description of Artificial Sequence: Synthetic oligonucleotide"
ucaucauuauacagggcuuuuaa

SEQ ID NO: 1023 - RNA, 19 nt, Artificial Sequence
  source: /note="Description of Artificial Sequence: Synthetic oligonucleotide"
gcugccgggacggguccaa

SEQ ID NO: 1024 - RNA, 19 nt, Artificial Sequence
  source: /note="Description of Artificial Sequence: Synthetic oligonucleotide"
gacggguccaagauggacg

SEQ ID NO: 1025 - RNA, 19 nt, Artificial Sequence
  source: /note="Description of Artificial Sequence: Synthetic oligonucleotide"
caagauggacggccgcuca

SEQ ID NO: 1026 - RNA, 19 nt, Artificial Sequence
  source: /note="Description of Artificial Sequence: Synthetic oligonucleotide"
acggccgcucagguucugc

SEQ ID NO: 1027 - RNA, 19 nt, Artificial Sequence
  source: /note="Description of Artificial Sequence: Synthetic oligonucleotide"
ucagguucugcuuuuaccu

SEQ ID NO: 1028 - RNA, 19 nt, Artificial Sequence
  source: /note="Description of Artificial Sequence: Synthetic oligonucleotide"
ugcuuuuaccugcggccca

SEQ ID NO: 1029 - RNA, 19 nt, Artificial Sequence
  source: /note="Description of Artificial Sequence: Synthetic oligonucleotide"
accugcggcccagagcccc

SEQ ID NO: 1030 - RNA, 19 nt, Artificial Sequence
  source: /note="Description of Artificial Sequence: Synthetic oligonucleotide"
cccagagccccauucauug

SEQ ID NO: 1031 - RNA, 19 nt, Artificial Sequence
  source: /note="Description of Artificial Sequence: Synthetic oligonucleotide"
cccauucauugccccggug

SEQ ID NO: 1032 - RNA, 19 nt, Artificial Sequence
  source: /note="Description of Artificial Sequence: Synthetic oligonucleotide"
uugccccggugcugagcgg

SEQ ID NO: 1033 - RNA, 19 nt, Artificial Sequence
  source: /note="Description of Artificial Sequence: Synthetic oligonucleotide"
gugcugagcggcgccgcga

SEQ ID NO: 1034 - RNA, 19 nt, Artificial Sequence
  source: /note="Description of Artificial Sequence: Synthetic oligonucleotide"
cggcgccgcgagucggccc

SEQ ID NO: 1035 - RNA, 19 nt, Artificial Sequence
  source: /note="Description of Artificial Sequence: Synthetic oligonucleotide"
cugccgggacggguccaag

SEQ ID NO: 1036 - RNA, 19 nt, Artificial Sequence
  source: /note="Description of Artificial Sequence: Synthetic oligonucleotide"
acggguccaagauggacgg

SEQ ID NO: 1037 - RNA, 19 nt, Artificial Sequence
  source: /note="Description of Artificial Sequence: Synthetic oligonucleotide"
aagauggacggccgcucag

SEQ ID NO: 1038 - RNA, 19 nt, Artificial Sequence
  source: /note="Description of Artificial Sequence: Synthetic oligonucleotide"
cggccgcucagguucugcu

SEQ ID NO: 1039 - RNA, 19 nt, Artificial Sequence
  source: /note="Description of Artificial Sequence: Synthetic oligonucleotide"
cagguucugcuuuuaccug

SEQ ID NO: 1040 - RNA, 19 nt, Artificial Sequence
  source: /note="Description of Artificial Sequence: Synthetic oligonucleotide"
gcuuuuaccugcggcccag

SEQ ID NO: 1041 - RNA, 19 nt, Artificial Sequence
  source: /note="Description of Artificial Sequence: Synthetic oligonucleotide"
ccugcggcccagagcccca

SEQ ID NO: 1042 - RNA, 19 nt, Artificial Sequence
  source: /note="Description of Artificial Sequence: Synthetic oligonucleotide"
ccagagccccauucauugc

SEQ ID NO: 1043 - RNA, 19 nt, Artificial Sequence
  source: /note="Description of Artificial Sequence: Synthetic oligonucleotide"
ccauucauugccccggugc

SEQ ID NO: 1044 - RNA, 19 nt, Artificial Sequence
  source: /note="Description of Artificial Sequence: Synthetic oligonucleotide"
ugccccggugcugagcggc

SEQ ID NO: 1045 - RNA, 19 nt, Artificial Sequence
  source: /note="Description of Artificial Sequence: Synthetic oligonucleotide"
ugcugagcggcgccgcgag

SEQ ID NO: 1046 - RNA, 19 nt, Artificial Sequence
  source: /note="Description of Artificial Sequence: Synthetic oligonucleotide"
ggcgccgcgagucggcccg

SEQ ID NO: 1047 - RNA, 19 nt, Artificial Sequence
  source: /note="Description of Artificial Sequence: Synthetic oligonucleotide"
ugccgggacggguccaaga

SEQ ID NO: 1048 - RNA, 19 nt, Artificial Sequence
  source: /note="Description of Artificial Sequence: Synthetic oligonucleotide"
cggguccaagauggacggc

SEQ ID NO: 1049 - RNA, 19 nt, Artificial Sequence
  source: /note="Description of Artificial Sequence: Synthetic oligonucleotide"
agauggacggccgcucagg

SEQ ID NO: 1050 - RNA, 19 nt, Artificial Sequence
  source: /note="Description of Artificial Sequence: Synthetic oligonucleotide"
ggccgcucagguucugcuu

SEQ ID NO: 1051 - RNA, 19 nt, Artificial Sequence
  source: /note="Description of Artificial Sequence: Synthetic oligonucleotide"
agguucugcuuuuaccugc

SEQ ID NO: 1052 - RNA, 19 nt, Artificial Sequence
  source: /note="Description of Artificial Sequence: Synthetic oligonucleotide"
cuuuuaccugcggcccaga

SEQ ID NO: 1053 - RNA, 19 nt, Artificial Sequence
  source: /note="Description of Artificial Sequence: Synthetic oligonucleotide"
cugcggcccagagccccau

SEQ ID NO: 1054 - RNA, 19 nt, Artificial Sequence
  source: /note="Description of Artificial Sequence: Synthetic oligonucleotide"
cagagccccauucauugcc

SEQ ID NO: 1055 - RNA, 19 nt, Artificial Sequence
  source: /note="Description of Artificial Sequence: Synthetic oligonucleotide"
cauucauugccccggugcu

SEQ ID NO: 1056 - RNA, 19 nt, Artificial Sequence
  source: /note="Description of Artificial Sequence: Synthetic oligonucleotide"
gccccggugcugagcggcg

SEQ ID NO: 1057 - RNA, 19 nt, Artificial Sequence
  source: /note="Description of Artificial Sequence: Synthetic oligonucleotide"
gcugagcggcgccgcgagu

SEQ ID NO: 1058 - RNA, 19 nt, Artificial Sequence
  source: /note="Description of Artificial Sequence: Synthetic oligonucleotide"
gcgccgcgagucggcccga

SEQ ID NO: 1059 - RNA, 19 nt, Artificial Sequence
  source: /note="Description of Artificial Sequence: Synthetic oligonucleotide"
gccgggacggguccaagau

SEQ ID NO: 1060 - RNA, 19 nt, Artificial Sequence
  source: /note="Description of Artificial Sequence: Synthetic oligonucleotide"
ggguccaagauggacggcc

SEQ ID NO: 1061 - RNA, 19 nt, Artificial Sequence
  source: /note="Description of Artificial Sequence: Synthetic oligonucleotide"
gauggacggccgcucaggu

SEQ ID NO: 1062 - RNA, 19 nt, Artificial Sequence
  source: /note="Description of Artificial Sequence: Synthetic oligonucleotide"
gccgcucagguucugcuuu

SEQ ID NO: 1063 - RNA, 19 nt, Artificial Sequence
  source: /note="Description of Artificial Sequence: Synthetic oligonucleotide"
gguucugcuuuuaccugcg

SEQ ID NO: 1064 - RNA, 19 nt, Artificial Sequence
  source: /note="Description of Artificial Sequence: Synthetic oligonucleotide"
uuuuaccugcggcccagag

SEQ ID NO: 1065 - RNA, 19 nt, Artificial Sequence
  source: /note="Description of Artificial Sequence: Synthetic oligonucleotide"
ugcggcccagagccccauu

SEQ ID NO: 1066 - RNA, 19 nt, Artificial Sequence
  source: /note="Description of Artificial Sequence: Synthetic oligonucleotide"
agagccccauucauugccc

SEQ ID NO: 1067 - RNA, 19 nt, Artificial Sequence
  source: /note="Description of Artificial Sequence: Synthetic oligonucleotide"
auucauugccccggugcug

SEQ ID NO: 1068 - RNA, 19 nt, Artificial Sequence
  source: /note="Description of Artificial Sequence: Synthetic oligonucleotide"
ccccggugcugagcggcgc

SEQ ID NO: 1069 - RNA, 19 nt, Artificial Sequence
  source: /note="Description of Artificial Sequence: Synthetic oligonucleotide"
cugagcggcgccgcgaguc

SEQ ID NO: 1070 - RNA, 19 nt, Artificial Sequence
  source: /note="Description of Artificial Sequence: Synthetic oligonucleotide"
cgccgcgagucggcccgag

SEQ ID NO: 1071 - RNA, 19 nt, Artificial Sequence
  source: /note="Description of Artificial Sequence: Synthetic oligonucleotide"
ccgggacggguccaagaug

SEQ ID NO: 1072 - RNA, 19 nt, Artificial Sequence
  source: /note="Description of Artificial Sequence: Synthetic oligonucleotide"
gguccaagauggacggccg

SEQ ID NO: 1073 - RNA, 19 nt, Artificial Sequence
  source: /note="Description of Artificial Sequence: Synthetic oligonucleotide"
auggacggccgcucagguu

SEQ ID NO: 1074 - RNA, 19 nt, Artificial Sequence
  source: /note="Description of Artificial Sequence: Synthetic oligonucleotide"
ccgcucagguucugcuuuu

SEQ ID NO: 1075 - RNA, 19 nt, Artificial Sequence
  source: /note="Description of Artificial Sequence: Synthetic oligonucleotide"
guucugcuuuuaccugcgg

SEQ ID NO: 1076 - RNA, 19 nt, Artificial Sequence
  source: /note="Description of Artificial Sequence: Synthetic oligonucleotide"
uuuaccugcggcccagagc

SEQ ID NO: 1077 - RNA, 19 nt, Artificial Sequence
  source: /note="Description of Artificial Sequence: Synthetic oligonucleotide"
gcggcccagagccccauuc

SEQ ID NO: 1078 - RNA, 19 nt, Artificial Sequence
  source: /note="Description of Artificial Sequence: Synthetic oligonucleotide"
gagccccauucauugcccc

SEQ ID NO: 1079 - RNA, 19 nt, Artificial Sequence
  source: /note="Description of Artificial Sequence: Synthetic oligonucleotide"
uucauugccccggugcuga

SEQ ID NO: 1080 - RNA, 19 nt, Artificial Sequence
  source: /note="Description of Artificial Sequence: Synthetic oligonucleotide"
cccggugcugagcggcgcc

SEQ ID NO: 1081 - RNA, 19 nt, Artificial Sequence
  source: /note="Description of Artificial Sequence: Synthetic oligonucleotide"
ugagcggcgccgcgagucg

SEQ ID NO: 1082 - RNA, 19 nt, Artificial Sequence
  source: /note="Description of Artificial Sequence: Synthetic oligonucleotide"
gccgcgagucggcccgagg

SEQ ID NO: 1083 - RNA, 19 nt, Artificial Sequence
  source: /note="Description of Artificial Sequence: Synthetic oligonucleotide"
cgggacggguccaagaugg

SEQ ID NO: 1084 - RNA, 19 nt, Artificial Sequence
  source: /note="Description of Artificial Sequence: Synthetic oligonucleotide"
guccaagauggacggccgc

SEQ ID NO: 1085 - RNA, 19 nt, Artificial Sequence
  source: /note="Description of Artificial Sequence: Synthetic oligonucleotide"
uggacggccgcucagguuc

SEQ ID NO: 1086 - RNA, 19 nt, Artificial Sequence
  source: /note="Description of Artificial Sequence: Synthetic oligonucleotide"
cgcucagguucugcuuuua

SEQ ID NO: 1087 - RNA, 19 nt, Artificial Sequence
  source: /note="Description of Artificial Sequence: Synthetic oligonucleotide"
uucugcuuuuaccugcggc

SEQ ID NO: 1088 - RNA, 19 nt, Artificial Sequence
  source: /note="Description of Artificial Sequence: Synthetic oligonucleotide"
uuaccugcggcccagagcc

SEQ ID NO: 1089 - RNA, 19 nt, Artificial Sequence
  source: /note="Description of Artificial Sequence: Synthetic oligonucleotide"
cggcccagagccccauuca

SEQ ID NO: 1090 - RNA, 19 nt, Artificial Sequence
  source: /note="Description of Artificial Sequence: Synthetic oligonucleotide"
agccccauucauugccccg

SEQ ID NO: 1091 - RNA, 19 nt, Artificial Sequence
  source: /note="Description of Artificial Sequence: Synthetic oligonucleotide"
ucauugccccggugcugag

SEQ ID NO: 1092 - RNA, 19 nt, Artificial Sequence
  source: /note="Description of Artificial Sequence: Synthetic oligonucleotide"
ccggugcugagcggcgccg

SEQ ID NO: 1093 - RNA, 19 nt, Artificial Sequence
  source: /note="Description of Artificial Sequence: Synthetic oligonucleotide"
gagcggcgccgcgagucgg

SEQ ID NO: 1094 - RNA, 19 nt, Artificial Sequence
  source: /note="Description of Artificial Sequence: Synthetic oligonucleotide"
ccgcgagucggcccgaggc

SEQ ID NO: 1095 - RNA, 19 nt, Artificial Sequence
  source: /note="Description of Artificial Sequence: Synthetic oligonucleotide"
gggacggguccaagaugga

SEQ ID NO: 1096 - RNA, 19 nt, Artificial Sequence
  source: /note="Description of Artificial Sequence: Synthetic oligonucleotide"
uccaagauggacggccgcu

SEQ ID NO: 1097 - RNA, 19 nt, Artificial Sequence
  source: /note="Description of Artificial Sequence: Synthetic oligonucleotide"
ggacggccgcucagguucu

SEQ ID NO: 1098 - RNA, 19 nt, Artificial Sequence
  source: /note="Description of Artificial Sequence: Synthetic oligonucleotide"
gcucagguucugcuuuuac

SEQ ID NO: 1099 - RNA, 19 nt, Artificial Sequence
  source: /note="Description of Artificial Sequence: Synthetic oligonucleotide"
ucugcuuuuaccugcggcc

SEQ ID NO: 1100 - RNA, 19 nt, Artificial Sequence
  source: /note="Description of Artificial Sequence: Synthetic oligonucleotide"
uaccugcggcccagagccc

SEQ ID NO: 1101 - RNA, 19 nt, Artificial Sequence
  source: /note="Description of Artificial Sequence: Synthetic oligonucleotide"
ggcccagagccccauucau

SEQ ID NO: 1102 - RNA, 19 nt, Artificial Sequence
  source: /note="Description of Artificial Sequence: Synthetic oligonucleotide"
gccccauucauugccccgg

SEQ ID NO: 1103 - RNA, 19 nt, Artificial Sequence
  source: /note="Description of Artificial Sequence: Synthetic oligonucleotide"
cauugccccggugcugagc

SEQ ID NO: 1104 - RNA, 19 nt, Artificial Sequence
  source: /note="Description of Artificial Sequence: Synthetic oligonucleotide"
cggugcugagcggcgccgc

SEQ ID NO: 1105 - RNA, 19 nt, Artificial Sequence
  source: /note="Description of Artificial Sequence: Synthetic oligonucleotide"
cgcgagucggcccgaggcc

SEQ ID NO: 1106 - RNA, 19 nt, Artificial Sequence
  source: /note="Description of Artificial Sequence: Synthetic oligonucleotide"
ggacggguccaagauggac

SEQ ID NO: 1107 - RNA, 19 nt, Artificial Sequence
  source: /note="Description of Artificial Sequence: Synthetic oligonucleotide"
ccaagauggacggccgcuc

SEQ ID NO: 1108 - RNA, 19 nt, Artificial Sequence
  source: /note="Description of Artificial Sequence: Synthetic oligonucleotide"
gacggccgcucagguucug

SEQ ID NO: 1109 - RNA, 19 nt, Artificial Sequence
  source: /note="Description of Artificial Sequence: Synthetic oligonucleotide"
cucagguucugcuuuuacc

SEQ ID NO: 1110 - RNA, 19 nt, Artificial Sequence
  source: /note="Description of Artificial Sequence: Synthetic oligonucleotide"
cugcuuuuaccugcggccc

SEQ ID NO: 1111 - RNA, 19 nt, Artificial Sequence
  source: /note="Description of Artificial Sequence: Synthetic oligonucleotide"
gcccagagccccauucauu

SEQ ID NO: 1112 - RNA, 19 nt, Artificial Sequence
  source: /note="Description of Artificial Sequence: Synthetic oligonucleotide"
ccccauucauugccccggu

SEQ ID NO: 1113 - RNA, 19 nt, Artificial Sequence
  source: /note="Description of Artificial Sequence: Synthetic oligonucleotide"
auugccccggugcugagcg

SEQ ID NO: 1114 - RNA, 19 nt, Artificial Sequence
  source: /note="Description of Artificial Sequence: Synthetic oligonucleotide"
ggugcugagcggcgccgcg

SEQ ID NO: 1115 - RNA, 19 nt, Artificial Sequence
  source: /note="Description of Artificial Sequence: Synthetic oligonucleotide"
gcgagucggcccgaggccu

SEQ ID NO: 1116 - RNA, 19 nt, Artificial Sequence
  source: /note="Description of Artificial Sequence: Synthetic oligonucleotide"
gcccgaggccuccggggac

SEQ ID NO: 1117 - RNA, 19 nt, Artificial Sequence
  source: /note="Description of Artificial Sequence: Synthetic oligonucleotide"
ccuccggggacugccgugc

SEQ ID NO: 1118 - RNA, 19 nt, Artificial Sequence
  source: /note="Description of Artificial Sequence: Synthetic oligonucleotide"
gacugccgugccgggcggg

SEQ ID NO: 1119 - RNA, 19 nt, Artificial Sequence
  source: /note="Description of Artificial Sequence: Synthetic oligonucleotide"
ugccgggcgggagaccgcc

SEQ ID NO: 1120 - RNA, 19 nt, Artificial Sequence
  source: /note="Description of Artificial Sequence: Synthetic oligonucleotide"
gggagaccgccauggcgac

SEQ ID NO: 1121 - RNA, 19 nt, Artificial Sequence
  source: /note="Description of Artificial Sequence: Synthetic oligonucleotide"
cgccauggcgacccuggaa

SEQ ID NO: 1122 - RNA, 19 nt, Artificial Sequence
  source: /note="Description of Artificial Sequence: Synthetic oligonucleotide"
cgacccuggaaaagcugau

SEQ ID NO: 1123 - RNA, 19 nt, Artificial Sequence
  source: /note="Description of Artificial Sequence: Synthetic oligonucleotide"
acugccgugccgggcggga

SEQ ID NO: 1124 - RNA, 19 nt, Artificial Sequence
  source: /note="Description of Artificial Sequence: Synthetic oligonucleotide"
gccgggcgggagaccgcca

SEQ ID NO: 1125 - RNA, 19 nt, Artificial Sequence
  source: /note="Description of Artificial Sequence: Synthetic oligonucleotide"
ggagaccgccauggcgacc

SEQ ID NO: 1126 - RNA, 19 nt, Artificial Sequence
  source: /note="Description of Artificial Sequence: Synthetic oligonucleotide"
gacccuggaaaagcugaug

SEQ ID NO: 1127 - RNA, 19 nt, Artificial Sequence
  source: /note="Description of Artificial Sequence: Synthetic oligonucleotide"
aaaagcugaugaaggccuu

SEQ ID NO: 1128 - RNA, 19 nt, Artificial Sequence
  source: /note="Description of Artificial Sequence: Synthetic oligonucleotide"
augaaggccuucgaguccc

SEQ ID NO: 1129 - RNA, 19 nt, Artificial Sequence
  source: /note="Description of Artificial Sequence: Synthetic oligonucleotide"
cuucgagucccucaagucc

SEQ ID NO: 1130 - RNA, 19 nt, Artificial Sequence
  source: /note="Description of Artificial Sequence: Synthetic oligonucleotide"
gagucggcccgaggccucc

SEQ ID NO: 1131 - RNA, 19 nt, Artificial Sequence
  source: /note="Description of Artificial Sequence: Synthetic oligonucleotide"
ccgaggccuccggggacug

SEQ ID NO: 1132 - RNA, 19 nt, Artificial Sequence
  source: /note="Description of Artificial Sequence: Synthetic oligonucleotide"
uccggggacugccgugccg

SEQ ID NO: 1133 - RNA, 19 nt, Artificial Sequence
  source: /note="Description of Artificial Sequence: Synthetic oligonucleotide"
cugccgugccgggcgggag

SEQ ID NO: 1134 - RNA, 19 nt, Artificial Sequence
  source: /note="Description of Artificial Sequence: Synthetic oligonucleotide"
ccgggcgggagaccgccau

SEQ ID NO: 1135 - RNA, 19 nt, Artificial Sequence
  source: /note="Description of Artificial Sequence: Synthetic oligonucleotide"
gagaccgccauggcgaccc

SEQ ID NO: 1136 - RNA, 19 nt, Artificial Sequence
  source: /note="Description of Artificial Sequence: Synthetic oligonucleotide"
ccauggcgacccuggaaaa

SEQ ID NO: 1137 - RNA, 19 nt, Artificial Sequence
  source: /note="Description of Artificial Sequence: Synthetic oligonucleotide"
acccuggaaaagcugauga

SEQ ID NO: 1138 - RNA, 19 nt, Artificial Sequence
  source: /note="Description of Artificial Sequence: Synthetic oligonucleotide"
aaagcugaugaaggccuuc

SEQ ID NO: 1139 - RNA, 19 nt, Artificial Sequence
  source: /note="Description of Artificial Sequence: Synthetic oligonucleotide"
ugaaggccuucgagucccu

SEQ ID NO: 1140 - RNA, 19 nt, Artificial Sequence
  source: /note="Description of Artificial Sequence: Synthetic oligonucleotide"
uucgagucccucaaguccu

SEQ ID NO: 1141 - RNA, 19 nt, Artificial Sequence
  source: /note="Description of Artificial Sequence: Synthetic oligonucleotide"
agucggcccgaggccuccg

SEQ ID NO: 1142 - RNA, 19 nt, Artificial Sequence
  source: /note="Description of Artificial Sequence: Synthetic oligonucleotide"
cgaggccuccggggacugc

SEQ ID NO: 1143 - RNA, 19 nt, Artificial Sequence
  source: /note="Description of Artificial Sequence: Synthetic oligonucleotide"
ccggggacugccgugccgg

SEQ ID NO: 1144 - RNA, 19 nt, Artificial Sequence
  source: /note="Description of Artificial Sequence: Synthetic oligonucleotide"
ugccgugccgggcgggaga

SEQ ID NO: 1145 - RNA, 19 nt, Artificial Sequence
  source: /note="Description of Artificial Sequence: Synthetic oligonucleotide"
cgggcgggagaccgccaug

SEQ ID NO: 1146 - RNA, 19 nt, Artificial Sequence
  source: /note="Description of Artificial Sequence: Synthetic oligonucleotide"
agaccgccauggcgacccu

SEQ ID NO: 1147 - RNA, 19 nt, Artificial Sequence
  source: /note="Description of Artificial Sequence: Synthetic oligonucleotide"
cauggcgacccuggaaaag

SEQ ID NO: 1148 - RNA, 19 nt, Artificial Sequence
  source: /note="Description of Artificial Sequence: Synthetic oligonucleotide"
cccuggaaaagcugaugaa

SEQ ID NO: 1149 - RNA, 19 nt, Artificial Sequence
  source: /note="Description of Artificial Sequence: Synthetic oligonucleotide"
aagcugaugaaggccuucg

SEQ ID NO: 1150 - RNA, 19 nt, Artificial Sequence
  source: /note="Description of Artificial Sequence: Synthetic oligonucleotide"
gaaggccuucgagucccuc

SEQ ID NO: 1151 - RNA, 19 nt, Artificial Sequence
  source: /note="Description of Artificial Sequence: Synthetic oligonucleotide"
ucgagucccucaaguccuu

SEQ ID NO: 1152 - RNA, 19 nt, Artificial Sequence
  source: /note="Description of Artificial Sequence: Synthetic oligonucleotide"
gucggcccgaggccuccgg

SEQ ID NO: 1153 - RNA, 19 nt, Artificial Sequence
  source: /note="Description of Artificial Sequence: Synthetic oligonucleotide"
gaggccuccggggacugcc

SEQ ID NO: 1154 - RNA, 19 nt, Artificial Sequence
  source: /note="Description of Artificial Sequence: Synthetic oligonucleotide"
cggggacugccgugccggg

SEQ ID NO: 1155 - RNA, 19 nt, Artificial Sequence
  source: /note="Description of Artificial Sequence: Synthetic oligonucleotide"
gccgugccgggcgggagac

SEQ ID NO: 1156 - RNA, 19 nt, Artificial Sequence
  source: /note="Description of Artificial Sequence: Synthetic oligonucleotide"
gggcgggagaccgccaugg

SEQ ID NO: 1157 - RNA, 19 nt, Artificial Sequence
  source: /note="Description of Artificial Sequence: Synthetic oligonucleotide"
gaccgccauggcgacccug

SEQ ID NO: 1158 - RNA, 19 nt, Artificial Sequence
  source: /note="Description of Artificial Sequence: Synthetic oligonucleotide"
auggcgacccuggaaaagc

SEQ ID NO: 1159 - RNA, 19 nt, Artificial Sequence
  source: /note="Description of Artificial Sequence: Synthetic oligonucleotide"
ccuggaaaagcugaugaag

SEQ ID NO: 1160 - RNA, 19 nt, Artificial Sequence
  source: /note="Description of Artificial Sequence: Synthetic oligonucleotide"
agcugaugaaggccuucga

SEQ ID NO: 1161 - RNA, 19 nt, Artificial Sequence
  source: /note="Description of Artificial Sequence: Synthetic oligonucleotide"
aaggccuucgagucccuca

SEQ ID NO: 1162 - RNA, 19 nt, Artificial Sequence
  source: /note="Description of Artificial Sequence: Synthetic oligonucleotide"
cgagucccucaaguccuuc

SEQ ID NO: 1163 - RNA, 19 nt, Artificial Sequence
  source: /note="Description of Artificial Sequence: Synthetic oligonucleotide"
ucggcccgaggccuccggg

SEQ ID NO: 1164 - RNA, 19 nt, Artificial Sequence
  source: /note="Description of Artificial Sequence: Synthetic oligonucleotide"
aggccuccggggacugccg

SEQ ID NO: 1165 - RNA, 19 nt, Artificial Sequence
  source: /note="Description of Artificial Sequence: Synthetic oligonucleotide"
ggggacugccgugccgggc

SEQ ID NO: 1166 - RNA, 19 nt, Artificial Sequence
  source: /note="Description of Artificial Sequence: Synthetic oligonucleotide"
ccgugccgggcgggagacc

SEQ ID NO: 1167 - RNA, 19 nt, Artificial Sequence
  source: /note="Description of Artificial Sequence: Synthetic oligonucleotide"
ggcgggagaccgccauggc

SEQ ID NO: 1168 - RNA, 19 nt, Artificial Sequence
  source: /note="Description of Artificial Sequence: Synthetic oligonucleotide"
accgccauggcgacccugg

SEQ ID NO: 1169 - RNA, 19 nt, Artificial Sequence
  source: /note="Description of Artificial Sequence: Synthetic oligonucleotide"
uggcgacccuggaaaagcu

SEQ ID NO: 1170 - RNA, 19 nt, Artificial Sequence
  source: /note="Description of Artificial Sequence: Synthetic oligonucleotide"
cuggaaaagcugaugaagg

SEQ ID NO: 1171 - RNA, 19 nt, Artificial Sequence
  source: /note="Description of Artificial Sequence: Synthetic oligonucleotide"
gcugaugaaggccuucgag

SEQ ID NO: 1172 - RNA, 19 nt, Artificial Sequence
  source: /note="Description of Artificial Sequence: Synthetic oligonucleotide"
aggccuucgagucccucaa

SEQ ID NO: 1173 - RNA, 19 nt, Artificial Sequence
  source: /note="Description of Artificial Sequence: Synthetic oligonucleotide"
gagucccucaaguccuucc

SEQ ID NO: 1174 - RNA, 19 nt, Artificial Sequence
  source: /note="Description of Artificial Sequence: Synthetic oligonucleotide"
cggcccgaggccuccgggg

SEQ ID NO: 1175 - RNA, 19 nt, Artificial Sequence
  source: /note="Description of Artificial Sequence: Synthetic oligonucleotide"
ggccuccggggacugccgu

SEQ ID NO: 1176 - RNA, 19 nt, Artificial Sequence
  source: /note="Description of Artificial Sequence: Synthetic oligonucleotide"
gggacugccgugccgggcg

SEQ ID NO: 1177 - RNA, 19 nt, Artificial Sequence
  source: /note="Description of Artificial Sequence: Synthetic oligonucleotide"
cgugccgggcgggagaccg

SEQ ID NO: 1178 - RNA, 19 nt, Artificial Sequence
  source: /note="Description of Artificial Sequence: Synthetic oligonucleotide"
gcgggagaccgccauggcg

SEQ ID NO: 1179 - RNA, 19 nt, Artificial Sequence
  source: /note="Description of Artificial Sequence: Synthetic oligonucleotide"
ccgccauggcgacccugga

SEQ ID NO: 1180 - RNA, 19 nt, Artificial Sequence
  source: /note="Description of Artificial Sequence: Synthetic oligonucleotide"
ggcgacccuggaaaagcug

SEQ ID NO: 1181 - RNA, 19 nt, Artificial Sequence
  source: /note="Description of Artificial Sequence: Synthetic oligonucleotide"
uggaaaagcugaugaaggc

SEQ ID NO: 1182 - RNA, 19 nt, Artificial Sequence
  source: /note="Description of Artificial Sequence: Synthetic oligonucleotide"
cugaugaaggccuucgagu

SEQ ID NO: 1183 - RNA, 19 nt, Artificial Sequence
  source: /note="Description of Artificial Sequence: Synthetic oligonucleotide"
ggccuucgagucccucaag

SEQ ID NO: 1184 - RNA, 19 nt, Artificial Sequence
  source: /note="Description of Artificial Sequence: Synthetic oligonucleotide"
agucccucaaguccuucca

SEQ ID NO: 1185 - RNA, 19 nt, Artificial Sequence
  source: /note="Description of Artificial Sequence: Synthetic oligonucleotide"
ggcccgaggccuccgggga

SEQ ID NO: 1186 - RNA, 19 nt, Artificial Sequence
  source: /note="Description of Artificial Sequence: Synthetic oligonucleotide"
gccuccggggacugccgug

SEQ ID NO: 1187 - RNA, 19 nt, Artificial Sequence
  source: /note="Description of Artificial Sequence: Synthetic oligonucleotide"
ggacugccgugccgggcgg

SEQ ID NO: 1188 - RNA, 19 nt, Artificial Sequence
  source: /note="Description of Artificial Sequence: Synthetic oligonucleotide"
gugccgggcgggagaccgc

SEQ ID NO: 1189 - RNA, 19 nt, Artificial Sequence
  source: /note="Description of Artificial Sequence: Synthetic oligonucleotide"
cgggagaccgccauggcga

SEQ ID NO: 1190 - RNA, 19 nt, Artificial Sequence
  source: /note="Description of Artificial Sequence: Synthetic oligonucleotide"
gcgacccuggaaaagcuga

SEQ ID NO: 1191 - RNA, 19 nt, Artificial Sequence
  source: /note="Description of Artificial Sequence: Synthetic oligonucleotide"
ggaaaagcugaugaaggcc

SEQ ID NO: 1192 - RNA, 19 nt, Artificial Sequence
  source: /note="Description of Artificial Sequence: Synthetic oligonucleotide"
ugaugaaggccuucgaguc

SEQ ID NO: 1193 - RNA, 19 nt, Artificial Sequence
  source: /note="Description of Artificial Sequence: Synthetic oligonucleotide"
gccuucgagucccucaagu

SEQ ID NO: 1194 - RNA, 19 nt, Artificial Sequence
  source: /note="Description of Artificial Sequence: Synthetic oligonucleotide"
uuggacccgucccggcagc

SEQ ID NO: 1195 - RNA, 19 nt, Artificial Sequence
  source: /note="Description of Artificial Sequence: Synthetic oligonucleotide"
cguccaucuuggacccguc

SEQ ID NO: 1196 - RNA, 19 nt, Artificial Sequence
  source: /note="Description of Artificial Sequence: Synthetic oligonucleotide"
ugagcggccguccaucuug

SEQ ID NO: 1197 - RNA, 19 nt, Artificial Sequence
  source: /note="Description of Artificial Sequence: Synthetic oligonucleotide"
gcagaaccugagcggccgu

SEQ ID NO: 1198 - RNA, 19 nt, Artificial Sequence
  source: /note="Description of Artificial Sequence: Synthetic oligonucleotide"
agguaaaagcagaaccuga

SEQ ID NO: 1199 - RNA, 19 nt, Artificial Sequence
  source: /note="Description of Artificial Sequence: Synthetic oligonucleotide"
ugggccgcagguaaaagca

SEQ ID NO: 1200 - RNA, 19 nt, Artificial Sequence
  source: /note="Description of Artificial Sequence: Synthetic oligonucleotide"
ggggcucugggccgcaggu

SEQ ID NO: 1201 - RNA, 19 nt, Artificial Sequence
  source: /note="Description of Artificial Sequence: Synthetic oligonucleotide"
caaugaauggggcucuggg

SEQ ID NO: 1202 - RNA, 19 nt, Artificial Sequence
  source: /note="Description of Artificial Sequence: Synthetic oligonucleotide"
caccggggcaaugaauggg

SEQ ID NO: 1203 - RNA, 19 nt, Artificial Sequence
  source: /note="Description of Artificial Sequence: Synthetic oligonucleotide"
ccgcucagcaccggggcaa

SEQ ID NO: 1204 - RNA, 19 nt, Artificial Sequence
  source: /note="Description of Artificial Sequence: Synthetic oligonucleotide"
ucgcggcgccgcucagcac

SEQ ID NO: 1205 - RNA, 19 nt, Artificial Sequence
  source: /note="Description of Artificial Sequence: Synthetic oligonucleotide"
gggccgacucgcggcgccg

SEQ ID NO: 1206 - RNA, 19 nt, Artificial Sequence
  source: /note="Description of Artificial Sequence: Synthetic oligonucleotide"
cuuggacccgucccggcag

SEQ ID NO: 1207 - RNA, 19 nt, Artificial Sequence
  source: /note="Description of Artificial Sequence: Synthetic oligonucleotide"
ccguccaucuuggacccgu

SEQ ID NO: 1208 - RNA, 19 nt, Artificial Sequence
  source: /note="Description of Artificial Sequence: Synthetic oligonucleotide"
cugagcggccguccaucuu

SEQ ID NO: 1209 - RNA, 19 nt, Artificial Sequence
  source: /note="Description of Artificial Sequence: Synthetic oligonucleotide"
agcagaaccugagcggccg

SEQ ID NO: 1210 - RNA, 19 nt, Artificial Sequence
  source: /note="Description of Artificial Sequence: Synthetic oligonucleotide"
cagguaaaagcagaaccug

SEQ ID NO: 1211 - RNA, 19 nt, Artificial Sequence
  source: /note="Description of Artificial Sequence: Synthetic oligonucleotide"
cugggccgcagguaaaagc

SEQ ID NO: 1212 - RNA, 19 nt, Artificial Sequence
  source: /note="Description of Artificial Sequence: Synthetic oligonucleotide"
uggggcucugggccgcagg

SEQ ID NO: 1213 - RNA, 19 nt, Artificial Sequence
  source: /note="Description of Artificial Sequence: Synthetic oligonucleotide"
gcaaugaauggggcucugg

SEQ ID NO: 1214 - RNA, 19 nt, Artificial Sequence
  source: /note="Description of Artificial Sequence: Synthetic oligonucleotide"
gcaccggggcaaugaaugg

SEQ ID NO: 1215 - RNA, 19 nt, Artificial Sequence
  source: /note="Description of Artificial Sequence: Synthetic oligonucleotide"
gccgcucagcaccggggca

SEQ ID NO: 1216 - RNA, 19 nt, Artificial Sequence
  source: /note="Description of Artificial Sequence: Synthetic oligonucleotide"
cucgcggcgccgcucagca

SEQ ID NO: 1217 - RNA, 19 nt, Artificial Sequence
  source: /note="Description of Artificial Sequence: Synthetic oligonucleotide"
cgggccgacucgcggcgcc

SEQ ID NO: 1218 - RNA, 19 nt, Artificial Sequence
  source: /note="Description of Artificial Sequence: Synthetic oligonucleotide"
ucuuggacccgucccggca

SEQ ID NO: 1219 - RNA, 19 nt, Artificial Sequence
  source: /note="Description of Artificial Sequence: Synthetic oligonucleotide"
gccguccaucuuggacccg

SEQ ID NO: 1220 - RNA, 19 nt, Artificial Sequence
  source: /note="Description of Artificial Sequence: Synthetic oligonucleotide"
ccugagcggccguccaucu

SEQ ID NO: 1221 - RNA, 19 nt, Artificial Sequence
  source: /note="Description of Artificial Sequence: Synthetic oligonucleotide"
aagcagaaccugagcggcc

SEQ ID NO: 1222 - RNA, 19 nt, Artificial Sequence
  source: /note="Description of Artificial Sequence: Synthetic oligonucleotide"
gcagguaaaagcagaaccu

SEQ ID NO: 1223 - RNA, 19 nt, Artificial Sequence
  source: /note="Description of Artificial Sequence: Synthetic oligonucleotide"
ucugggccgcagguaaaag

SEQ ID NO: 1224 - RNA, 19 nt, Artificial Sequence
  source: /note="Description of Artificial Sequence: Synthetic oligonucleotide"
auggggcucugggccgcag

SEQ ID NO: 1225 - RNA, 19 nt, Artificial Sequence
  source: /note="Description of Artificial Sequence: Synthetic oligonucleotide"
ggcaaugaauggggcucug

SEQ ID NO: 1226 - RNA, 19 nt, Artificial Sequence
  source: /note="Description of Artificial Sequence: Synthetic oligonucleotide"
agcaccggggcaaugaaug

SEQ ID NO: 1227 - RNA, 19 nt, Artificial Sequence
  source: /note="Description of Artificial Sequence: Synthetic oligonucleotide"
cgccgcucagcaccggggc

SEQ ID NO: 1228 - RNA, 19 nt, Artificial Sequence
  source: /note="Description of Artificial Sequence: Synthetic oligonucleotide"
acucgcggcgccgcucagc

SEQ ID NO: 1229 - RNA, 19 nt, Artificial Sequence
  source: /note="Description of Artificial Sequence: Synthetic oligonucleotide"
ucgggccgacucgcggcgc

SEQ ID NO: 1230 - RNA, 19 nt, Artificial Sequence
  source: /note="Description of Artificial Sequence: Synthetic oligonucleotide"
aucuuggacccgucccggc

SEQ ID NO: 1231 - RNA, 19 nt, Artificial Sequence
  source: /note="Description of Artificial Sequence: Synthetic oligonucleotide"
ggccguccaucuuggaccc

SEQ ID NO: 1232 - RNA, 19 nt, Artificial Sequence
  source: /note="Description of Artificial Sequence: Synthetic oligonucleotide"
accugagcggccguccauc

SEQ ID NO: 1233 - RNA, 19 nt, Artificial Sequence
  source: /note="Description of Artificial Sequence: Synthetic oligonucleotide"
aaagcagaaccugagcggc

SEQ ID NO: 1234 - RNA, 19 nt, Artificial Sequence
  source: /note="Description of Artificial Sequence: Synthetic oligonucleotide"
cgcagguaaaagcagaacc

SEQ ID NO: 1235 - RNA, 19 nt, Artificial Sequence
  source: /note="Description of Artificial Sequence: Synthetic oligonucleotide"
cucugggccgcagguaaaa

SEQ ID NO: 1236 - RNA, 19 nt, Artificial Sequence
  source: /note="Description of Artificial Sequence: Synthetic oligonucleotide"
aauggggcucugggccgca

SEQ ID NO: 1237 - RNA, 19 nt, Artificial Sequence
  source: /note="Description of Artificial Sequence: Synthetic oligonucleotide"
gggcaaugaauggggcucu

SEQ ID NO: 1238 - RNA, 19 nt, Artificial Sequence
  source: /note="Description of Artificial Sequence: Synthetic oligonucleotide"
cagcaccggggcaaugaau

SEQ ID NO: 1239 - RNA, 19 nt, Artificial Sequence
  source: /note="Description of Artificial Sequence: Synthetic oligonucleotide"
gcgccgcucagcaccgggg

SEQ ID NO: 1240 - RNA, 19 nt, Artificial Sequence
  source: /note="Description of Artificial Sequence: Synthetic oligonucleotide"
gacucgcggcgccgcucag

SEQ ID NO: 1241 - RNA, 19 nt, Artificial Sequence
  source: /note="Description of Artificial Sequence: Synthetic oligonucleotide"
cucgggccgacucgcggcg

SEQ ID NO: 1242 - RNA, 19 nt, Artificial Sequence
  source: /note="Description of Artificial Sequence: Synthetic oligonucleotide"
caucuuggacccgucccgg

SEQ ID NO: 1243 - RNA, 19 nt, Artificial Sequence
  source: /note="Description of Artificial Sequence: Synthetic oligonucleotide"
cggccguccaucuuggacc

SEQ ID NO: 1244 - RNA, 19 nt, Artificial Sequence
  source: /note="Description of Artificial Sequence: Synthetic oligonucleotide"
aaccugagcggccguccau

SEQ ID NO: 1245 - RNA, 19 nt, Artificial Sequence
  source: /note="Description of Artificial Sequence: Synthetic oligonucleotide"
aaaagcagaaccugagcgg

SEQ ID NO: 1246 - RNA, 19 nt, Artificial Sequence
  source: /note="Description of Artificial Sequence: Synthetic oligonucleotide"
ccgcagguaaaagcagaac

SEQ ID NO: 1247 - RNA, 19 nt, Artificial Sequence
  source: /note="Description of Artificial Sequence: Synthetic oligonucleotide"
gcucugggccgcagguaaa

SEQ ID NO: 1248 - RNA, 19 nt, Artificial Sequence
  source: /note="Description of Artificial Sequence: Synthetic oligonucleotide"
gaauggggcucugggccgc

SEQ ID NO: 1249 - RNA, 19 nt, Artificial Sequence
  source: /note="Description of Artificial Sequence: Synthetic oligonucleotide"
ggggcaaugaauggggcuc

SEQ ID NO: 1250 - RNA, 19 nt, Artificial Sequence
  source: /note="Description of Artificial Sequence: Synthetic oligonucleotide"
ucagcaccggggcaaugaa

SEQ ID NO: 1251 - RNA, 19 nt, Artificial Sequence
  source: /note="Description of Artificial Sequence: Synthetic oligonucleotide"
ggcgccgcucagcaccggg

SEQ ID NO: 1252 - RNA, 19 nt, Artificial Sequence
  source: /note="Description of Artificial Sequence: Synthetic oligonucleotide"
cgacucgcggcgccgcuca

SEQ ID NO: 1253 - RNA, 19 nt, Artificial Sequence
  source: /note="Description of Artificial Sequence: Synthetic oligonucleotide"
ccucgggccgacucgcggc

SEQ ID NO: 1254 - RNA, 19 nt, Artificial Sequence
  source: /note="Description of Artificial Sequence: Synthetic oligonucleotide"
ccaucuuggacccgucccg

SEQ ID NO: 1255 - RNA, 19 nt, Artificial Sequence
  source: /note="Description of Artificial Sequence: Synthetic oligonucleotide"
gcggccguccaucuuggac

SEQ ID NO: 1256 - RNA, 19 nt, Artificial Sequence
  source: /note="Description of Artificial Sequence: Synthetic oligonucleotide"
gaaccugagcggccgucca

SEQ ID NO: 1257 - RNA, 19 nt, Artificial Sequence
  source: /note="Description of Artificial Sequence: Synthetic oligonucleotide"
uaaaagcagaaccugagcg

SEQ ID NO: 1258 - RNA, 19 nt, Artificial Sequence
  source: /note="Description of Artificial Sequence: Synthetic oligonucleotide"
gccgcagguaaaagcagaa

SEQ ID NO: 1259 - RNA, 19 nt, Artificial Sequence
  source: /note="Description of Artificial Sequence: Synthetic oligonucleotide"
ggcucugggccgcagguaa

SEQ ID NO: 1260 - RNA, 19 nt, Artificial Sequence
  source: /note="Description of Artificial Sequence: Synthetic oligonucleotide"
ugaauggggcucugggccg

SEQ ID NO: 1261 - RNA, 19 nt, Artificial Sequence
  source: /note="Description of Artificial Sequence: Synthetic oligonucleotide"
cggggcaaugaauggggcu

SEQ ID NO: 1262 - RNA, 19 nt, Artificial Sequence
  source: /note="Description of Artificial Sequence: Synthetic oligonucleotide"
cucagcaccggggcaauga

SEQ ID NO: 1263 - RNA, 19 nt, Artificial Sequence
  source: /note="Description of Artificial Sequence: Synthetic oligonucleotide"
cggcgccgcucagcaccgg

SEQ ID NO: 1264 - RNA, 19 nt, Artificial Sequence
  source: /note="Description of Artificial Sequence: Synthetic oligonucleotide"
ccgacucgcggcgccgcuc

SEQ ID NO: 1265 - RNA, 19 nt, Artificial Sequence
  source: /note="Description of Artificial Sequence: Synthetic oligonucleotide"
gccucgggccgacucgcgg

SEQ ID NO: 1266 - RNA, 19 nt, Artificial Sequence
  source: /note="Description of Artificial Sequence: Synthetic oligonucleotide"
uccaucuuggacccguccc

SEQ ID NO: 1267 - RNA, 19 nt, Artificial Sequence
  source: /note="Description of Artificial Sequence: Synthetic oligonucleotide"
agcggccguccaucuugga

SEQ ID NO: 1268 - RNA, 19 nt, Artificial Sequence
  source: /note="Description of Artificial Sequence: Synthetic oligonucleotide"
agaaccugagcggccgucc

SEQ ID NO: 1269 - RNA, 19 nt, Artificial Sequence
  source: /note="Description of Artificial Sequence: Synthetic oligonucleotide"
guaaaagcagaaccugagc

SEQ ID NO: 1270 - RNA, 19 nt, Artificial Sequence
  source: /note="Description of Artificial Sequence: Synthetic oligonucleotide"
ggccgcagguaaaagcaga

SEQ ID NO: 1271 - RNA, 19 nt, Artificial Sequence
  source: /note="Description of Artificial Sequence: Synthetic oligonucleotide"
gggcucugggccgcaggua

SEQ ID NO: 1272 - RNA, 19 nt, Artificial Sequence
  source: /note="Description of Artificial Sequence: Synthetic oligonucleotide"
augaauggggcucugggcc

SEQ ID NO: 1273 - RNA, 19 nt, Artificial Sequence
  source: /note="Description of Artificial Sequence: Synthetic oligonucleotide"
ccggggcaaugaauggggc

SEQ ID NO: 1274 - RNA, 19 nt, Artificial Sequence
  source: /note="Description of Artificial Sequence: Synthetic oligonucleotide"
gcucagcaccggggcaaug

SEQ ID NO: 1275 - RNA, 19 nt, Artificial Sequence
  source: /note="Description of Artificial Sequence: Synthetic oligonucleotide"
gcggcgccgcucagcaccg

SEQ ID NO: 1276 - RNA, 19 nt, Artificial Sequence
  source: /note="Description of Artificial Sequence: Synthetic oligonucleotide"
ggccucgggccgacucgcg

SEQ ID NO: 1277 - RNA, 19 nt, Artificial Sequence
  source: /note="Description of Artificial Sequence: Synthetic oligonucleotide"
guccaucuuggacccgucc

SEQ ID NO: 1278 - RNA, 19 nt, Artificial Sequence
  source: /note="Description of Artificial Sequence: Synthetic oligonucleotide"
gagcggccguccaucuugg

SEQ ID NO: 1279 - RNA, 19 nt, Artificial Sequence
  source: /note="Description of Artificial Sequence: Synthetic oligonucleotide"
cagaaccugagcggccguc

SEQ ID NO: 1280 - RNA, 19 nt, Artificial Sequence
  source: /note="Description of Artificial Sequence: Synthetic oligonucleotide"
gguaaaagcagaaccugag

SEQ ID NO: 1281 - RNA, 19 nt, Artificial Sequence
  source: /note="Description of Artificial Sequence: Synthetic oligonucleotide"
gggccgcagguaaaagcag

SEQ ID NO: 1282 - RNA, 19 nt, Artificial Sequence
  source: /note="Description of Artificial Sequence: Synthetic oligonucleotide"
aaugaauggggcucugggc

SEQ ID NO: 1283 - RNA, 19 nt, Artificial Sequence
  source: /note="Description of Artificial Sequence: Synthetic oligonucleotide"
accggggcaaugaaugggg

SEQ ID NO: 1284 - RNA, 19 nt, Artificial Sequence
  source: /note="Description of Artificial Sequence: Synthetic oligonucleotide"
cgcucagcaccggggcaau

SEQ ID NO: 1285 - RNA, 19 nt, Artificial Sequence
  source: /note="Description of Artificial Sequence: Synthetic oligonucleotide"
cgcggcgccgcucagcacc

SEQ ID NO: 1286 - RNA, 19 nt, Artificial Sequence
  source: /note="Description of Artificial Sequence: Synthetic oligonucleotide"
aggccucgggccgacucgc

SEQ ID NO: 1287 - RNA, 19 nt, Artificial Sequence
  source: /note="Description of Artificial Sequence: Synthetic oligonucleotide"
guccccggaggccucgggc

SEQ ID NO: 1288 - RNA, 19 nt, Artificial Sequence
  source: /note="Description of Artificial Sequence: Synthetic oligonucleotide"
gcacggcaguccccggagg

SEQ ID NO: 1289 - RNA, 19 nt, Artificial Sequence
  source: /note="Description of Artificial Sequence: Synthetic oligonucleotide"
cccgcccggcacggcaguc

SEQ ID NO: 1290 - RNA, 19 nt, Artificial Sequence
  source: /note="Description of Artificial Sequence: Synthetic oligonucleotide"
ggcggucucccgcccggca

SEQ ID NO: 1291 - RNA, 19 nt, Artificial Sequence
  source: /note="Description of Artificial Sequence: Synthetic oligonucleotide"
gucgccauggcggucuccc

SEQ ID NO: 1292 - RNA, 19 nt, Artificial Sequence
  source: /note="Description of Artificial Sequence: Synthetic oligonucleotide"
uuccagggucgccauggcg

SEQ ID NO: 1293 - RNA, 19 nt, Artificial Sequence
  source: /note="Description of Artificial Sequence: Synthetic oligonucleotide"
aucagcuuuuccagggucg

SEQ ID NO: 1294 - RNA, 19 nt, Artificial Sequence
  source: /note="Description of Artificial Sequence: Synthetic oligonucleotide"
ucccgcccggcacggcagu

SEQ ID NO: 1295 - RNA, 19 nt, Artificial Sequence
  source: /note="Description of Artificial Sequence: Synthetic oligonucleotide"
uggcggucucccgcccggc

SEQ ID NO: 1296 - RNA, 19 nt, Artificial Sequence
  source: /note="Description of Artificial Sequence: Synthetic oligonucleotide"
ggucgccauggcggucucc

SEQ ID NO: 1297 - RNA, 19 nt, Artificial Sequence
  source: /note="Description of Artificial Sequence: Synthetic oligonucleotide"
caucagcuuuuccaggguc

SEQ ID NO: 1298 - RNA, 19 nt, Artificial Sequence
  source: /note="Description of Artificial Sequence: Synthetic oligonucleotide"
aaggccuucaucagcuuuu

SEQ ID NO: 1299 - RNA, 19 nt, Artificial Sequence
  source: /note="Description of Artificial Sequence: Synthetic oligonucleotide"
gggacucgaaggccuucau

SEQ ID NO: 1300 - RNA, 19 nt, Artificial Sequence
  source: /note="Description of Artificial Sequence: Synthetic oligonucleotide"
ggacuugagggacucgaag

SEQ ID NO: 1301 - RNA, 19 nt, Artificial Sequence
  source: /note="Description of Artificial Sequence: Synthetic oligonucleotide"
ggaggccucgggccgacuc

SEQ ID NO: 1302 - RNA, 19 nt, Artificial Sequence
  source: /note="Description of Artificial Sequence: Synthetic oligonucleotide"
caguccccggaggccucgg

SEQ ID NO: 1303 - RNA, 19 nt, Artificial Sequence
  source: /note="Description of Artificial Sequence: Synthetic oligonucleotide"
cggcacggcaguccccgga

SEQ ID NO: 1304 - RNA, 19 nt, Artificial Sequence
  source: /note="Description of Artificial Sequence: Synthetic oligonucleotide"
cucccgcccggcacggcag

SEQ ID NO: 1305 - RNA, 19 nt, Artificial Sequence
  source: /note="Description of Artificial Sequence: Synthetic oligonucleotide"
auggcggucucccgcccgg

SEQ ID NO: 1306 - RNA, 19 nt, Artificial Sequence
  source: /note="Description of Artificial Sequence: Synthetic oligonucleotide"
gggucgccauggcggucuc

SEQ ID NO: 1307 - RNA, 19 nt, Artificial Sequence
  source: /note="Description of Artificial Sequence: Synthetic oligonucleotide"
uuuuccagggucgccaugg

SEQ ID NO: 1308 - RNA, 19 nt, Artificial Sequence
  source: /note="Description of Artificial Sequence: Synthetic oligonucleotide"
ucaucagcuuuuccagggu

SEQ ID NO: 1309 - RNA, 19 nt, Artificial Sequence
  source: /note="Description of Artificial Sequence: Synthetic oligonucleotide"
gaaggccuucaucagcuuu

SEQ ID NO: 1310 - RNA, 19 nt, Artificial Sequence
  source: /note="Description of Artificial Sequence: Synthetic oligonucleotide"
agggacucgaaggccuuca

SEQ ID NO: 1311 - RNA, 19 nt, Artificial Sequence
  source: /note="Description of Artificial Sequence: Synthetic oligonucleotide"
aggacuugagggacucgaa

SEQ ID NO: 1312 - RNA, 19 nt, Artificial Sequence
  source: /note="Description of Artificial Sequence: Synthetic oligonucleotide"
cggaggccucgggccgacu

SEQ ID NO: 1313 - RNA, 19 nt, Artificial Sequence
  source: /note="Description of Artificial Sequence: Synthetic oligonucleotide"
gcaguccccggaggccucg

SEQ ID NO: 1314 - RNA, 19 nt, Artificial Sequence
  source: /note="Description of Artificial Sequence: Synthetic oligonucleotide"
ccggcacggcaguccccgg

SEQ ID NO: 1315 - RNA, 19 nt, Artificial Sequence
  source: /note="Description of Artificial Sequence: Synthetic oligonucleotide"
ucucccgcccggcacggca

SEQ ID NO: 1316 - RNA, 19 nt, Artificial Sequence
  source: /note="Description of Artificial Sequence: Synthetic oligonucleotide"
cauggcggucucccgcccg

SEQ ID NO: 1317 - RNA, 19 nt, Artificial Sequence
  source: /note="Description of Artificial Sequence: Synthetic oligonucleotide"
agggucgccauggcggucu

SEQ ID NO: 1318 - RNA, 19 nt, Artificial Sequence
  source: /note="Description of Artificial Sequence: Synthetic oligonucleotide"
cuuuuccagggucgccaug

SEQ ID NO: 1319 - RNA, 19 nt, Artificial Sequence
  source: /note="Description of Artificial Sequence: Synthetic oligonucleotide"
uucaucagcuuuuccaggg

SEQ ID NO: 1320 - RNA, 19 nt, Artificial Sequence
  source: /note="Description of Artificial Sequence: Synthetic oligonucleotide"
cgaaggccuucaucagcuu

SEQ ID NO: 1321 - RNA, 19 nt, Artificial Sequence
  source: /note="Description of Artificial Sequence: Synthetic oligonucleotide"
gagggacucgaaggccuuc

SEQ ID NO: 1322 - RNA, 19 nt, Artificial Sequence
  source: /note="Description of Artificial Sequence: Synthetic oligonucleotide"
aaggacuugagggacucga

SEQ ID NO: 1323 - RNA, 19 nt, Artificial Sequence
  source: /note="Description of Artificial Sequence: Synthetic oligonucleotide"
ccggaggccucgggccgac

SEQ ID NO: 1324 - RNA, 19 nt, Artificial Sequence
  source: /note="Description of Artificial Sequence: Synthetic oligonucleotide"
ggcaguccccggaggccuc

SEQ ID NO: 1325 - RNA, 19 nt, Artificial Sequence
  source: /note="Description of Artificial Sequence: Synthetic oligonucleotide"
cccggcacggcaguccccg

SEQ ID NO: 1326 - RNA, 19 nt, Artificial Sequence
  source: /note="Description of Artificial Sequence: Synthetic oligonucleotide"
gucucccgcccggcacggc

SEQ ID NO: 1327 - RNA, 19 nt, Artificial Sequence
  source: /note="Description of Artificial Sequence: Synthetic oligonucleotide"
ccauggcggucucccgccc

SEQ ID NO: 1328 - RNA, 19 nt, Artificial Sequence
  source: /note="Description of Artificial Sequence: Synthetic oligonucleotide"
cagggucgccauggcgguc

SEQ ID NO: 1329 - RNA, 19 nt, Artificial Sequence
  source: /note="Description of Artificial Sequence: Synthetic oligonucleotide"
gcuuuuccagggucgccau

SEQ ID NO: 1330 - RNA, 19 nt, Artificial Sequence
  source: /note="Description of Artificial Sequence: Synthetic oligonucleotide"
cuucaucagcuuuuccagg

SEQ ID NO: 1331 - RNA, 19 nt, Artificial Sequence
  source: /note="Description of Artificial Sequence: Synthetic oligonucleotide"
ucgaaggccuucaucagcu

SEQ ID NO: 1332 - RNA, 19 nt, Artificial Sequence
  source: /note="Description of Artificial Sequence: Synthetic oligonucleotide"
ugagggacucgaaggccuu

SEQ ID NO: 1333 - RNA, 19 nt, Artificial Sequence
  source: /note="Description of Artificial Sequence: Synthetic oligonucleotide"
gaaggacuugagggacucg

SEQ ID NO: 1334 - RNA, 19 nt, Artificial Sequence
  source: /note="Description of Artificial Sequence: Synthetic oligonucleotide"
cccggaggccucgggccga

SEQ ID NO: 1335 - RNA, 19 nt, Artificial Sequence
  source: /note="Description of Artificial Sequence: Synthetic oligonucleotide"
cggcaguccccggaggccu

SEQ ID NO: 1336 - RNA, 19 nt, Artificial Sequence
  source: /note="Description of Artificial Sequence: Synthetic oligonucleotide"
gcccggcacggcagucccc

SEQ ID NO: 1337 - RNA, 19 nt, Artificial Sequence
  source: /note="Description of Artificial Sequence: Synthetic oligonucleotide"
ggucucccgcccggcacgg

SEQ ID NO: 1338 - RNA, 19 nt, Artificial Sequence
  source: /note="Description of Artificial Sequence: Synthetic oligonucleotide"
gccauggcggucucccgcc

SEQ ID NO: 1339 - RNA, 19 nt, Artificial Sequence
  source: /note="Description of Artificial Sequence: Synthetic oligonucleotide"
ccagggucgccauggcggu

SEQ ID NO: 1340 - RNA, 19 nt, Artificial Sequence
  source: /note="Description of Artificial Sequence: Synthetic oligonucleotide"
agcuuuuccagggucgcca

SEQ ID NO: 1341 - RNA, 19 nt, Artificial Sequence
  source: /note="Description of Artificial Sequence: Synthetic oligonucleotide"
ccuucaucagcuuuuccag

SEQ ID NO: 1342 - RNA, 19 nt, Artificial Sequence
  source: /note="Description of Artificial Sequence: Synthetic oligonucleotide"
cucgaaggccuucaucagc

SEQ ID NO: 1343 - RNA, 19 nt, Artificial Sequence
  source: /note="Description of Artificial Sequence: Synthetic oligonucleotide"
uugagggacucgaaggccu

SEQ ID NO: 1344 - RNA, 19 nt, Artificial Sequence
  source: /note="Description of Artificial Sequence: Synthetic oligonucleotide"
ggaaggacuugagggacuc

SEQ ID NO: 1345 - RNA, 19 nt, Artificial Sequence
  source: /note="Description of Artificial Sequence: Synthetic oligonucleotide"
ccccggaggccucgggccg

SEQ ID NO: 1346 - RNA, 19 nt, Artificial Sequence
  source: /note="Description of Artificial Sequence: Synthetic oligonucleotide"
acggcaguccccggaggcc

SEQ ID NO: 1347 - RNA, 19 nt, Artificial Sequence
  source: /note="Description of Artificial Sequence: Synthetic oligonucleotide"
cgcccggcacggcaguccc

SEQ ID NO: 1348 - RNA, 19 nt, Artificial Sequence
  source: /note="Description of Artificial Sequence: Synthetic oligonucleotide"
cggucucccgcccggcacg

SEQ ID NO: 1349 - RNA, 19 nt, Artificial Sequence
  source: /note="Description of Artificial Sequence: Synthetic oligonucleotide"
cgccauggcggucucccgc

SEQ ID NO: 1350 - RNA, 19 nt, Artificial Sequence
  source: /note="Description of Artificial Sequence: Synthetic oligonucleotide"
uccagggucgccauggcgg

SEQ ID NO: 1351 - RNA, 19 nt, Artificial Sequence
  source: /note="Description of Artificial Sequence: Synthetic oligonucleotide"
cagcuuuuccagggucgcc

SEQ ID NO: 1352 - RNA, 19 nt, Artificial Sequence
  source: /note="Description of Artificial Sequence: Synthetic oligonucleotide"
gccuucaucagcuuuucca

SEQ ID NO: 1353 - RNA, 19 nt, Artificial Sequence
  source: /note="Description of Artificial Sequence: Synthetic oligonucleotide"
acucgaaggccuucaucag

SEQ ID NO: 1354 - RNA, 19 nt, Artificial Sequence
  source: /note="Description of Artificial Sequence: Synthetic oligonucleotide"
cuugagggacucgaaggcc

SEQ ID NO: 1355 - RNA, 19 nt, Artificial Sequence
  source: /note="Description of Artificial Sequence: Synthetic oligonucleotide"
uggaaggacuugagggacu

SEQ ID NO: 1356 - RNA, 19 nt, Artificial Sequence
  source: /note="Description of Artificial Sequence: Synthetic oligonucleotide"
uccccggaggccucgggcc

SEQ ID NO: 1357 - RNA, 19 nt, Artificial Sequence
  source: /note="Description of Artificial Sequence: Synthetic oligonucleotide"
cacggcaguccccggaggc

SEQ ID NO: 1358 - RNA, 19 nt, Artificial Sequence
  source: /note="Description of Artificial Sequence: Synthetic oligonucleotide"
ccgcccggcacggcagucc

SEQ ID NO: 1359 - RNA, 19 nt, Artificial Sequence
  source: /note="Description of Artificial Sequence: Synthetic oligonucleotide"
gcggucucccgcccggcac

SEQ ID NO: 1360 - RNA, 19 nt, Artificial Sequence
  source: /note="Description of Artificial Sequence: Synthetic oligonucleotide"
ucgccauggcggucucccg

SEQ ID NO: 1361 - RNA, 19 nt, Artificial Sequence
  source: /note="Description of Artificial Sequence: Synthetic oligonucleotide"
ucagcuuuuccagggucgc

SEQ ID NO: 1362 - RNA, 19 nt, Artificial Sequence
  source: /note="Description of Artificial Sequence: Synthetic oligonucleotide"
ggccuucaucagcuuuucc

SEQ ID NO: 1363 - RNA, 19 nt, Artificial Sequence
  source: /note="Description of Artificial Sequence: Synthetic oligonucleotide"
gacucgaaggccuucauca

SEQ ID NO: 1364 - RNA, 19 nt, Artificial Sequence
  source: /note="Description of Artificial Sequence: Synthetic oligonucleotide"
acuugagggacucgaaggc

SEQ ID NO: 1365 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugccgggacggguccaatt

SEQ ID NO: 1366 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacggguccaagauggacgtt

SEQ ID NO: 1367 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagauggacggccgcucatt

SEQ ID NO: 1368 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acggccgcucagguucugctt

SEQ ID NO: 1369 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagguucugcuuuuaccutt

SEQ ID NO: 1370 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuuuuaccugcggcccatt

SEQ ID NO: 1371 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugcggcccagagcccctt

SEQ ID NO: 1372 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccagagccccauucauugtt

SEQ ID NO: 1373 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccauucauugccccggugtt

SEQ ID NO: 1374 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugccccggugcugagcggtt

SEQ ID NO: 1375 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcugagcggcgccgcgatt

SEQ ID NO: 1376 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcgccgcgagucggccctt

SEQ ID NO: 1377 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccgggacggguccaagtt

SEQ ID NO: 1378 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acggguccaagauggacggtt

SEQ ID NO: 1379 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagauggacggccgcucagtt

SEQ ID NO: 1380 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggccgcucagguucugcutt

SEQ ID NO: 1381 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagguucugcuuuuaccugtt

SEQ ID NO: 1382 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuuuuaccugcggcccagtt

SEQ ID NO: 1383 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugcggcccagagccccatt

SEQ ID NO: 1384 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagagccccauucauugctt

SEQ ID NO: 1385 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauucauugccccggugctt

SEQ ID NO: 1386 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccccggugcugagcggctt

SEQ ID NO: 1387 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugagcggcgccgcgagtt

SEQ ID NO: 1388 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcgccgcgagucggcccgtt

SEQ ID NO: 1389 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgggacggguccaagatt

SEQ ID NO: 1390 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggguccaagauggacggctt

SEQ ID NO: 1391 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauggacggccgcucaggtt

SEQ ID NO: 1392 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccgcucagguucugcuutt

SEQ ID NO: 1393 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguucugcuuuuaccugctt

SEQ ID NO: 1394 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuuaccugcggcccagatt

SEQ ID NO: 1395 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcggcccagagccccautt

SEQ ID NO: 1396 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagagccccauucauugcctt

SEQ ID NO: 1397 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauucauugccccggugcutt

SEQ ID NO: 1398 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccccggugcugagcggcgtt

SEQ ID NO: 1399 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugagcggcgccgcgagutt

SEQ ID NO: 1400 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgccgcgagucggcccgatt

SEQ ID NO: 1401 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgggacggguccaagautt

SEQ ID NO: 1402 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguccaagauggacggcctt

SEQ ID NO: 1403 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauggacggccgcucaggutt

SEQ ID NO: 1404 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgcucagguucugcuuutt

SEQ ID NO: 1405 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguucugcuuuuaccugcgtt

SEQ ID NO: 1406 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuaccugcggcccagagtt

SEQ ID NO: 1407 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcggcccagagccccauutt

SEQ ID NO: 1408 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagccccauucauugccctt

SEQ ID NO: 1409 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucauugccccggugcugtt

SEQ ID NO: 1410 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccggugcugagcggcgctt

SEQ ID NO: 1411 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagcggcgccgcgaguctt

SEQ ID NO: 1412 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgccgcgagucggcccgagtt

SEQ ID NO: 1413 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgggacggguccaagaugtt

SEQ ID NO: 1414 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguccaagauggacggccgtt

SEQ ID NO: 1415 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggacggccgcucagguutt

SEQ ID NO: 1416 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcucagguucugcuuuutt

SEQ ID NO: 1417 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucugcuuuuaccugcggtt

SEQ ID NO: 1418 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaccugcggcccagagctt

SEQ ID NO: 1419 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggcccagagccccauuctt

SEQ ID NO: 1420 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagccccauucauugcccctt

SEQ ID NO: 1421 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucauugccccggugcugatt

SEQ ID NO: 1422 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccggugcugagcggcgcctt

SEQ ID NO: 1423 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagcggcgccgcgagucgtt

SEQ ID NO: 1424 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgcgagucggcccgaggtt

SEQ ID NO: 1425 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggacggguccaagauggtt

SEQ ID NO: 1426 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccaagauggacggccgctt

SEQ ID NO: 1427 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacggccgcucagguuctt

SEQ ID NO: 1428 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcucagguucugcuuuuatt

SEQ ID NO: 1429 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugcuuuuaccugcggctt

SEQ ID NO: 1430 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaccugcggcccagagcctt

SEQ ID NO: 1431 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcccagagccccauucatt

SEQ ID NO: 1432 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccccauucauugccccgtt

SEQ ID NO: 1433 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauugccccggugcugagtt

SEQ ID NO: 1434 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggugcugagcggcgccgtt

SEQ ID NO: 1435 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcggcgccgcgagucggtt

SEQ ID NO: 1436 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcgagucggcccgaggctt

SEQ ID NO: 1437 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggacggguccaagauggatt

SEQ ID NO: 1438 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaagauggacggccgcutt

SEQ ID NO: 1439 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacggccgcucagguucutt

SEQ ID NO: 1440 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucagguucugcuuuuactt

SEQ ID NO: 1441 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcuuuuaccugcggcctt

SEQ ID NO: 1442 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccugcggcccagagccctt

SEQ ID NO: 1443 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcccagagccccauucautt

SEQ ID NO: 1444 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccccauucauugccccggtt

SEQ ID NO: 1445 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauugccccggugcugagctt

SEQ ID NO: 1446 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggugcugagcggcgccgctt

SEQ ID NO: 1447 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcgagucggcccgaggcctt

SEQ ID NO: 1448 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacggguccaagauggactt

SEQ ID NO: 1449 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaagauggacggccgcuctt

SEQ ID NO: 1450 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacggccgcucagguucugtt

SEQ ID NO: 1451 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucagguucugcuuuuacctt

SEQ ID NO: 1452 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuuuuaccugcggccctt

SEQ ID NO: 1453 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccagagccccauucauutt

SEQ ID NO: 1454 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccauucauugccccggutt

SEQ ID NO: 1455 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugccccggugcugagcgtt

SEQ ID NO: 1456 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugcugagcggcgccgcgtt

SEQ ID NO: 1457 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgagucggcccgaggccutt

SEQ ID NO: 1458 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccgaggccuccggggactt

SEQ ID NO: 1459 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccggggacugccgugctt

SEQ ID NO: 1460 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacugccgugccgggcgggtt

SEQ ID NO: 1461 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgggcgggagaccgcctt

SEQ ID NO: 1462 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggagaccgccauggcgactt

SEQ ID NO: 1463 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgccauggcgacccuggaatt

SEQ ID NO: 1464 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgacccuggaaaagcugautt

SEQ ID NO: 1465 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugccgugccgggcgggatt

SEQ ID NO: 1466 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgggcgggagaccgccatt

SEQ ID NO: 1467 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagaccgccauggcgacctt

SEQ ID NO: 1468 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacccuggaaaagcugaugtt

SEQ ID NO: 1469 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagcugaugaaggccuutt

SEQ ID NO: 1470 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaaggccuucgaguccctt

SEQ ID NO: 1471 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucgagucccucaagucctt

SEQ ID NO: 1472 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagucggcccgaggccucctt

SEQ ID NO: 1473 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgaggccuccggggacugtt

SEQ ID NO: 1474 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggggacugccgugccgtt

SEQ ID NO: 1475 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugccgugccgggcgggagtt

SEQ ID NO: 1476 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgggcgggagaccgccautt

SEQ ID NO: 1477 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaccgccauggcgaccctt

SEQ ID NO: 1478 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauggcgacccuggaaaatt

SEQ ID NO: 1479 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccuggaaaagcugaugatt

SEQ ID NO: 1480 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcugaugaaggccuuctt

SEQ ID NO: 1481 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaggccuucgagucccutt

SEQ ID NO: 1482 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgagucccucaaguccutt

SEQ ID NO: 1483 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucggcccgaggccuccgtt

SEQ ID NO: 1484 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaggccuccggggacugctt

SEQ ID NO: 1485 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggggacugccgugccggtt

SEQ ID NO: 1486 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgugccgggcgggagatt

SEQ ID NO: 1487 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggcgggagaccgccaugtt

SEQ ID NO: 1488 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccgccauggcgacccutt

SEQ ID NO: 1489 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauggcgacccuggaaaagtt

SEQ ID NO: 1490 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccuggaaaagcugaugaatt

SEQ ID NO: 1491 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcugaugaaggccuucgtt

SEQ ID NO: 1492 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggccuucgagucccuctt

SEQ ID NO: 1493 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgagucccucaaguccuutt

SEQ ID NO: 1494 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucggcccgaggccuccggtt

SEQ ID NO: 1495 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggccuccggggacugcctt

SEQ ID NO: 1496 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggggacugccgugccgggtt

SEQ ID NO: 1497 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgugccgggcgggagactt

SEQ ID NO: 1498 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcgggagaccgccauggtt

SEQ ID NO: 1499 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaccgccauggcgacccugtt

SEQ ID NO: 1500 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggcgacccuggaaaagctt

SEQ ID NO: 1501 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuggaaaagcugaugaagtt

SEQ ID NO: 1502 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugaugaaggccuucgatt

SEQ ID NO: 1503 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggccuucgagucccucatt

SEQ ID NO: 1504 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgagucccucaaguccuuctt

SEQ ID NO: 1505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggcccgaggccuccgggtt

SEQ ID NO: 1506 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccuccggggacugccgtt

SEQ ID NO: 1507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggacugccgugccgggctt

SEQ ID NO: 1508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgugccgggcgggagacctt

SEQ ID NO: 1509 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcgggagaccgccauggctt

SEQ ID NO: 1510 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accgccauggcgacccuggtt

SEQ ID NO: 1511 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcgacccuggaaaagcutt

SEQ ID NO: 1512 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggaaaagcugaugaaggtt

SEQ ID NO: 1513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugaugaaggccuucgagtt

SEQ ID NO: 1514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccuucgagucccucaatt

SEQ ID NO: 1515 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagucccucaaguccuucctt

SEQ ID NO: 1516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcccgaggccuccggggtt

SEQ ID NO: 1517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccuccggggacugccgutt

SEQ ID NO: 1518 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggacugccgugccgggcgtt

SEQ ID NO: 1519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugccgggcgggagaccgtt

SEQ ID NO: 1520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgggagaccgccauggcgtt

SEQ ID NO: 1521 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccauggcgacccuggatt

SEQ ID NO: 1522 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcgacccuggaaaagcugtt

SEQ ID NO: 1523 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaaaagcugaugaaggctt

SEQ ID NO: 1524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaugaaggccuucgagutt

SEQ ID NO: 1525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccuucgagucccucaagtt

SEQ ID NO: 1526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucccucaaguccuuccatt

SEQ ID NO: 1527 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcccgaggccuccggggatt

SEQ ID NO: 1528 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuccggggacugccgugtt

SEQ ID NO: 1529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacugccgugccgggcggtt

SEQ ID NO: 1530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugccgggcgggagaccgctt

SEQ ID NO: 1531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggagaccgccauggcgatt

SEQ ID NO: 1532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgacccuggaaaagcugatt

SEQ ID NO: 1533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaaagcugaugaaggcctt

SEQ ID NO: 1534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugaaggccuucgaguctt

SEQ ID NO: 1535 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuucgagucccucaagutt

SEQ ID NO: 1536 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggacccgucccggcagctt

SEQ ID NO: 1537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguccaucuuggacccguctt

SEQ ID NO: 1538 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagcggccguccaucuugtt

SEQ ID NO: 1539 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagaaccugagcggccgutt

SEQ ID NO: 1540 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguaaaagcagaaccugatt

SEQ ID NO: 1541 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggccgcagguaaaagcatt

SEQ ID NO: 1542 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggcucugggccgcaggutt

SEQ ID NO: 1543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaugaauggggcucugggtt

SEQ ID NO: 1544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccggggcaaugaaugggtt

SEQ ID NO: 1545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcucagcaccggggcaatt

SEQ ID NO: 1546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcggcgccgcucagcactt

SEQ ID NO: 1547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggccgacucgcggcgccgtt

SEQ ID NO: 1548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuggacccgucccggcagtt

SEQ ID NO: 1549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccguccaucuuggacccgutt

SEQ ID NO: 1550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagcggccguccaucuutt

SEQ ID NO: 1551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagaaccugagcggccgtt

SEQ ID NO: 1552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagguaaaagcagaaccugtt

SEQ ID NO: 1553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggccgcagguaaaagctt

SEQ ID NO: 1554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcucugggccgcaggtt

SEQ ID NO: 1555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaaugaauggggcucuggtt

SEQ ID NO: 1556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaccggggcaaugaauggtt

SEQ ID NO: 1557 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgcucagcaccggggcatt

SEQ ID NO: 1558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucgcggcgccgcucagcatt

SEQ ID NO: 1559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggccgacucgcggcgcctt

SEQ ID NO: 1560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuggacccgucccggcatt

SEQ ID NO: 1561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccguccaucuuggacccgtt

SEQ ID NO: 1562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugagcggccguccaucutt

SEQ ID NO: 1563 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcagaaccugagcggcctt

SEQ ID NO: 1564 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagguaaaagcagaaccutt

SEQ ID NO: 1565 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugggccgcagguaaaagtt

SEQ ID NO: 1566 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggggcucugggccgcagtt

SEQ ID NO: 1567 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaaugaauggggcucugtt

SEQ ID NO: 1568 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaccggggcaaugaaugtt

SEQ ID NO: 1569 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgccgcucagcaccggggctt

SEQ ID NO: 1570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgcggcgccgcucagctt

SEQ ID NO: 1571 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgggccgacucgcggcgctt

SEQ ID NO: 1572 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuuggacccgucccggctt

SEQ ID NO: 1573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccguccaucuuggaccctt

SEQ ID NO: 1574 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugagcggccguccauctt

SEQ ID NO: 1575 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcagaaccugagcggctt

SEQ ID NO: 1576 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcagguaaaagcagaacctt

SEQ ID NO: 1577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugggccgcagguaaaatt

SEQ ID NO: 1578 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauggggcucugggccgcatt

SEQ ID NO: 1579 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcaaugaauggggcucutt

SEQ ID NO: 1580 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcaccggggcaaugaautt

SEQ ID NO: 1581 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgccgcucagcaccggggtt

SEQ ID NO: 1582 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacucgcggcgccgcucagtt

SEQ ID NO: 1583 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucgggccgacucgcggcgtt

SEQ ID NO: 1584 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuuggacccgucccggtt

SEQ ID NO: 1585 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggccguccaucuuggacctt

SEQ ID NO: 1586 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccugagcggccguccautt

SEQ ID NO: 1587 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagcagaaccugagcggtt

SEQ ID NO: 1588 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcagguaaaagcagaactt

SEQ ID NO: 1589 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucugggccgcagguaaatt

SEQ ID NO: 1590 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaauggggcucugggccgctt

SEQ ID NO: 1591 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggcaaugaauggggcuctt

SEQ ID NO: 1592 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcaccggggcaaugaatt

SEQ ID NO: 1593 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcgccgcucagcaccgggtt

SEQ ID NO: 1594 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgacucgcggcgccgcucatt

SEQ ID NO: 1595 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucgggccgacucgcggctt

SEQ ID NO: 1596 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaucuuggacccgucccgtt

SEQ ID NO: 1597 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggccguccaucuuggactt

SEQ ID NO: 1598 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaccugagcggccguccatt

SEQ ID NO: 1599 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaagcagaaccugagcgtt

SEQ ID NO: 1600 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccgcagguaaaagcagaatt

SEQ ID NO: 1601 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcucugggccgcagguaatt

SEQ ID NO: 1602 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaauggggcucugggccgtt

SEQ ID NO: 1603 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggggcaaugaauggggcutt

SEQ ID NO: 1604 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucagcaccggggcaaugatt

SEQ ID NO: 1605 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcgccgcucagcaccggtt

SEQ ID NO: 1606 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgacucgcggcgccgcuctt

SEQ ID NO: 1607 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccucgggccgacucgcggtt

SEQ ID NO: 1608 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaucuuggacccguccctt

SEQ ID NO: 1609 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcggccguccaucuuggatt

SEQ ID NO: 1610 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaccugagcggccgucctt

SEQ ID NO: 1611 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaaaagcagaaccugagctt

SEQ ID NO: 1612 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccgcagguaaaagcagatt

SEQ ID NO: 1613 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcucugggccgcagguatt

SEQ ID NO: 1614 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaauggggcucugggcctt

SEQ ID NO: 1615 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggggcaaugaauggggctt

SEQ ID NO: 1616 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcucagcaccggggcaaugtt

SEQ ID NO: 1617 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggcgccgcucagcaccgtt

SEQ ID NO: 1618 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccucgggccgacucgcgtt

SEQ ID NO: 1619 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccaucuuggacccgucctt

SEQ ID NO: 1620 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcggccguccaucuuggtt

SEQ ID NO: 1621 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaaccugagcggccguctt

SEQ ID NO: 1622 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguaaaagcagaaccugagtt

SEQ ID NO: 1623 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggccgcagguaaaagcagtt

SEQ ID NO: 1624 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugaauggggcucugggctt

SEQ ID NO: 1625 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accggggcaaugaauggggtt

SEQ ID NO: 1626 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcucagcaccggggcaautt

SEQ ID NO: 1627 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcggcgccgcucagcacctt

SEQ ID NO: 1628 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccucgggccgacucgctt

SEQ ID NO: 1629 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccccggaggccucgggctt

SEQ ID NO: 1630 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacggcaguccccggaggtt

SEQ ID NO: 1631 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccgcccggcacggcaguctt

SEQ ID NO: 1632 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcggucucccgcccggcatt

SEQ ID NO: 1633 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucgccauggcggucuccctt

SEQ ID NO: 1634 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccagggucgccauggcgtt

SEQ ID NO: 1635 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucagcuuuuccagggucgtt

SEQ ID NO: 1636 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccgcccggcacggcagutt

SEQ ID NO: 1637 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcggucucccgcccggctt

SEQ ID NO: 1638 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucgccauggcggucucctt

SEQ ID NO: 1639 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucagcuuuuccaggguctt

SEQ ID NO: 1640 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggccuucaucagcuuuutt

SEQ ID NO: 1641 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggacucgaaggccuucautt

SEQ ID NO: 1642 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacuugagggacucgaagtt

SEQ ID NO: 1643 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaggccucgggccgacuctt

SEQ ID NO: 1644 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguccccggaggccucggtt

SEQ ID NO: 1645 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcacggcaguccccggatt

SEQ ID NO: 1646 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucccgcccggcacggcagtt

SEQ ID NO: 1647 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggcggucucccgcccggtt

SEQ ID NO: 1648 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggucgccauggcggucuctt

SEQ ID NO: 1649 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuccagggucgccauggtt

SEQ ID NO: 1650 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucagcuuuuccagggutt

SEQ ID NO: 1651 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggccuucaucagcuuutt

SEQ ID NO: 1652 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggacucgaaggccuucatt

SEQ ID NO: 1653 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacuugagggacucgaatt

SEQ ID NO: 1654 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggaggccucgggccgacutt

SEQ ID NO: 1655 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaguccccggaggccucgtt

SEQ ID NO: 1656 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggcacggcaguccccggtt

SEQ ID NO: 1657 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucccgcccggcacggcatt

SEQ ID NO: 1658 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauggcggucucccgcccgtt

SEQ ID NO: 1659 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggucgccauggcggucutt

SEQ ID NO: 1660 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuuccagggucgccaugtt

SEQ ID NO: 1661 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaucagcuuuuccagggtt

SEQ ID NO: 1662 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaaggccuucaucagcuutt

SEQ ID NO: 1663 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagggacucgaaggccuuctt

SEQ ID NO: 1664 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggacuugagggacucgatt

SEQ ID NO: 1665 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggaggccucgggccgactt

SEQ ID NO: 1666 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaguccccggaggccuctt

SEQ ID NO: 1667 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccggcacggcaguccccgtt

SEQ ID NO: 1668 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucucccgcccggcacggctt

SEQ ID NO: 1669 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauggcggucucccgccctt

SEQ ID NO: 1670 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagggucgccauggcgguctt

SEQ ID NO: 1671 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuuuuccagggucgccautt

SEQ ID NO: 1672 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucaucagcuuuuccaggtt

SEQ ID NO: 1673 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaaggccuucaucagcutt

SEQ ID NO: 1674 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagggacucgaaggccuutt

SEQ ID NO: 1675 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggacuugagggacucgtt

SEQ ID NO: 1676 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccggaggccucgggccgatt

SEQ ID NO: 1677 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcaguccccggaggccutt

SEQ ID NO: 1678 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccggcacggcagucccctt

SEQ ID NO: 1679 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggucucccgcccggcacggtt

SEQ ID NO: 1680 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccauggcggucucccgcctt

SEQ ID NO: 1681 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagggucgccauggcggutt

SEQ ID NO: 1682 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuuuuccagggucgccatt

SEQ ID NO: 1683 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuucaucagcuuuuccagtt

SEQ ID NO: 1684 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucgaaggccuucaucagctt

SEQ ID NO: 1685 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugagggacucgaaggccutt

SEQ ID NO: 1686 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaggacuugagggacuctt

SEQ ID NO: 1687 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccggaggccucgggccgtt

SEQ ID NO: 1688 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acggcaguccccggaggcctt

SEQ ID NO: 1689 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcccggcacggcaguccctt

SEQ ID NO: 1690 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggucucccgcccggcacgtt

SEQ ID NO: 1691 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgccauggcggucucccgctt

SEQ ID NO: 1692 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagggucgccauggcggtt

SEQ ID NO: 1693 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcuuuuccagggucgcctt

SEQ ID NO: 1694 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccuucaucagcuuuuccatt

SEQ ID NO: 1695 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgaaggccuucaucagtt

SEQ ID NO: 1696 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugagggacucgaaggcctt

SEQ ID NO: 1697 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaaggacuugagggacutt

SEQ ID NO: 1698 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccggaggccucgggcctt

SEQ ID NO: 1699 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacggcaguccccggaggctt

SEQ ID NO: 1700 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcccggcacggcagucctt

SEQ ID NO: 1701 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggucucccgcccggcactt

SEQ ID NO: 1702 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgccauggcggucucccgtt

SEQ ID NO: 1703 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcuuuuccagggucgctt

SEQ ID NO: 1704 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccuucaucagcuuuucctt

SEQ ID NO: 1705 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacucgaaggccuucaucatt

SEQ ID NO: 1706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuugagggacucgaaggctt

SEQ ID NO: 1707 - RNA, 21 nt, Artificial Sequence
  source: /note="Description of Artificial Sequence: Synthetic oligonucleotide"
ucauaaucacauucguuugua

SEQ ID NO: 1708 - RNA, 21 nt, Artificial Sequence
  source: /note="Description of Artificial Sequence: Synthetic oligonucleotide"
uucaguuacggguuaauuaca

SEQ ID NO: 1709 - RNA, 21 nt, Artificial Sequence
  source: /note="Description of Artificial Sequence: Synthetic oligonucleotide"
acugucucgacagauagcuga

SEQ ID NO: 1710 - RNA, 21 nt, Artificial Sequence
  source: /note="Description of Artificial Sequence: Synthetic oligonucleotide"
uuacggaguauguucgucaca

SEQ ID NO: 1711 - RNA, 21 nt, Artificial Sequence
  source: /note="Description of Artificial Sequence: Synthetic oligonucleotide"
acuccgagcacuuaacgugga

SEQ ID NO: 1712 - RNA, 21 nt, Artificial Sequence
  source: /note="Description of Artificial Sequence: Synthetic oligonucleotide"
gcaauucagucucguugugaa

SEQ ID NO: 1713 - RNA, 21 nt, Artificial Sequence
  source: /note="Description of Artificial Sequence: Synthetic oligonucleotide"
ugccuucaugaugaacucgga

SEQ ID NO: 1714 - RNA, 21 nt, Artificial Sequence
  source: /note="Description of Artificial Sequence: Synthetic oligonucleotide"
caacagcuacacacgugugca

SEQ ID NO: 1715 - RNA, 21 nt, Artificial Sequence
  source: /note="Description of Artificial Sequence: Synthetic oligonucleotide"
gacgcugacagaacugcgaaa

SEQ ID NO: 1716 - RNA, 21 nt, Artificial Sequence
  source: /note="Description of Artificial Sequence: Synthetic oligonucleotide"
cugacuuguuuacgaaaugua

SEQ ID NO: 1717 - RNA, 21 nt, Artificial Sequence
  source: /note="Description of Artificial Sequence: Synthetic oligonucleotide"
aucacauucguuuguuugaaa

SEQ ID NO: 1718 - RNA, 21 nt, Artificial Sequence
  source: /note="Description of Artificial Sequence: Synthetic oligonucleotide"
caguuacggguuaauuacuga

SEQ ID NO: 1719 - RNA, 21 nt, Artificial Sequence
  source: /note="Description of Artificial Sequence: Synthetic oligonucleotide"
aagcccuuggaguguuaaaua

SEQ ID NO: 1720 - RNA, 21 nt, Artificial Sequence
  source: /note="Description of Artificial Sequence: Synthetic oligonucleotide"
ucugauuucccagucaacuga

SEQ ID NO: 1721 - RNA, 21 nt, Artificial Sequence
  source: /note="Description of Artificial Sequence: Synthetic oligonucleotide"
aucuucaagucuggaauguua

SEQ ID NO: 1722 - RNA, 21 nt, Artificial Sequence
  source: /note="Description of Artificial Sequence: Synthetic oligonucleotide"
auccaggcaauucagucucga

SEQ ID NO: 1723 - RNA, 21 nt, Artificial Sequence
  source: /note="Description of Artificial Sequence: Synthetic oligonucleotide"
auggucgacauccuugcuuga

SEQ ID NO: 1724 - RNA, 21 nt, Artificial Sequence
  source: /note="Description of Artificial Sequence: Synthetic oligonucleotide"
cuucaugaugaacucggagua

SEQ ID NO: 1725 - RNA, 21 nt, Artificial Sequence
  source: /note="Description of Artificial Sequence: Synthetic oligonucleotide"
gaccagucguacucaguuuga

SEQ ID NO: 1726 - RNA, 21 nt, Artificial Sequence
  source: /note="Description of Artificial Sequence: Synthetic oligonucleotide"
acgcugacagaacugcgaaga

SEQ ID NO: 1727 - RNA, 21 nt, Artificial Sequence
  source: /note="Description of Artificial Sequence: Synthetic oligonucleotide"
ugacuuguuuacgaaauguca

SEQ ID NO: 1728 - RNA, 21 nt, Artificial Sequence
  source: /note="Description of Artificial Sequence: Synthetic oligonucleotide"
ucagaucagguguuuauugga

SEQ ID NO: 1729 - RNA, 21 nt, Artificial Sequence
  source: /note="Description of Artificial Sequence: Synthetic oligonucleotide"
gcccuuggaguguuaaauaca

SEQ ID NO: 1730 - RNA, 21 nt, Artificial Sequence
  source: /note="Description of Artificial Sequence: Synthetic oligonucleotide"
ucaagucuggaauguuccgga

SEQ ID NO: 1731 - RNA, 21 nt, Artificial Sequence
  source: /note="Description of Artificial Sequence: Synthetic oligonucleotide"
uccaggcaauucagucucgua

SEQ ID NO: 1732 - RNA, 21 nt, Artificial Sequence
  source: /note="Description of Artificial Sequence: Synthetic oligonucleotide"
gucgacauccuugcuugucga

SEQ ID NO: 1733 - RNA, 21 nt, Artificial Sequence
  source: /note="Description of Artificial Sequence: Synthetic oligonucleotide"
cugcuagcuccaugcuuaaga

SEQ ID NO: 1734 - RNA, 21 nt, Artificial Sequence
  source: /note="Description of Artificial Sequence: Synthetic oligonucleotide"
accagucguacucaguuugaa

SEQ ID NO: 1735 - RNA, 21 nt, Artificial Sequence
  source: /note="Description of Artificial Sequence: Synthetic oligonucleotide"
gaaaggagaaagucaguccga

SEQ ID NO: 1736 - RNA, 21 nt, Artificial Sequence
  source: /note="Description of Artificial Sequence: Synthetic oligonucleotide"
uaacguaacucuuucuaugca

SEQ ID NO: 1737 - RNA, 21 nt, Artificial Sequence
  source: /note="Description of Artificial Sequence: Synthetic oligonucleotide"
uuggcuuuguauugaaacaga

SEQ ID NO: 1738 - RNA, 21 nt, Artificial Sequence
  source: /note="Description of Artificial Sequence: Synthetic oligonucleotide"
uagacaugcuuuuacggagua

SEQ ID NO: 1739 - RNA, 21 nt, Artificial Sequence
  source: /note="Description of Artificial Sequence: Synthetic oligonucleotide"
gauauuguucuuucucguaua

SEQ ID NO: 1740 - RNA, 21 nt, Artificial Sequence
  source: /note="Description of Artificial Sequence: Synthetic oligonucleotide"
caagucuggaauguuccggaa

SEQ ID NO: 1741 - RNA, 21 nt, Artificial Sequence
  source: /note="Description of Artificial Sequence: Synthetic oligonucleotide"
ccaggcaauucagucucguua

SEQ ID NO: 1742 - RNA, 21 nt, Artificial Sequence
  source: /note="Description of Artificial Sequence: Synthetic oligonucleotide"
caugcaagacucacuuaguca

SEQ ID NO: 1743 - RNA, 21 nt, Artificial Sequence
  source: /note="Description of Artificial Sequence: Synthetic oligonucleotide"
ugcuagcuccaugcuuaagca

SEQ ID NO: 1744 - RNA, 21 nt, Artificial Sequence
  source: /note="Description of Artificial Sequence: Synthetic oligonucleotide"
ccagucguacucaguuugaaa

SEQ ID NO: 1745 - RNA, 21 nt, Artificial Sequence
  source: /note="Description of Artificial Sequence: Synthetic oligonucleotide"
agaacuucagacccuaaucca

SEQ ID NO: 1746 - RNA, 21 nt, Artificial Sequence
  source: /note="Description of Artificial Sequence: Synthetic oligonucleotide"
ucuaugcccguguaaaguaua

SEQ ID NO: 1747 - RNA, 21 nt, Artificial Sequence
  source: /note="Description of Artificial Sequence: Synthetic oligonucleotide"
uuaugaacgcuaucauucaaa

SEQ ID NO: 1748 - RNA, 21 nt, Artificial Sequence
  source: /note="Description of Artificial Sequence: Synthetic oligonucleotide"
acaugcuuuuacggaguauga

SEQ ID NO: 1749 - RNA, 21 nt, Artificial Sequence
  source: /note="Description of Artificial Sequence: Synthetic oligonucleotide"
uuguucuuucucguauucaga

SEQ ID NO: 1750 - RNA, 21 nt, Artificial Sequence
  source: /note="Description of Artificial Sequence: Synthetic oligonucleotide"
agcacaaaguuacuuagucca

SEQ ID NO: 1751 - RNA, 21 nt, Artificial Sequence
  source: /note="Description of Artificial Sequence: Synthetic oligonucleotide"
caggcaauucagucucguuga

SEQ ID NO: 1752 - RNA, 21 nt, Artificial Sequence
  source: /note="Description of Artificial Sequence: Synthetic oligonucleotide"
augcaagacucacuuagucca

SEQ ID NO: 1753 - RNA, 21 nt, Artificial Sequence
  source: /note="Description of Artificial Sequence: Synthetic oligonucleotide"
acuggagcaaguugaaugaua

SEQ ID NO: 1754 - RNA, 21 nt, Artificial Sequence
  source: /note="Description of Artificial Sequence: Synthetic oligonucleotide"
ucaugaacaaagucaucggaa

SEQ ID NO: 1755 - RNA, 21 nt, Artificial Sequence
  source: /note="Description of Artificial Sequence: Synthetic oligonucleotide"
cuaugcccguguaaaguauga

SEQ ID NO: 1756 - RNA, 21 nt, Artificial Sequence
  source: /note="Description of Artificial Sequence: Synthetic oligonucleotide"
aagcuuuaaaacaguacacga

SEQ ID NO: 1757 - RNA, 21 nt, Artificial Sequence
  source: /note="Description of Artificial Sequence: Synthetic oligonucleotide"
aacgcuaucauucaaaacaga

SEQ ID NO: 1758 - RNA, 21 nt, Artificial Sequence
  source: /note="Description of Artificial Sequence: Synthetic oligonucleotide"
cuuuuacggaguauguucgua

SEQ ID NO: 1759 - RNA, 21 nt, Artificial Sequence
  source: /note="Description of Artificial Sequence: Synthetic oligonucleotide"
agaggaggauucugacuugga

SEQ ID NO: 1760 - RNA, 21 nt, Artificial Sequence
  source: /note="Description of Artificial Sequence: Synthetic oligonucleotide"
aggcaauucagucucguugua

SEQ ID NO: 1761 - RNA, 21 nt, Artificial Sequence
  source: /note="Description of Artificial Sequence: Synthetic oligonucleotide"
cacuggaaacagugaguccga

SEQ ID NO: 1762 - RNA, 21 nt, Artificial Sequence
  source: /note="Description of Artificial Sequence: Synthetic oligonucleotide"
ugucaacagcuacacacguga

SEQ ID NO: 1763 - RNA, 21 nt, Artificial Sequence
  source: /note="Description of Artificial Sequence: Synthetic oligonucleotide"
aagcugagcauuaucagagga

SEQ ID NO: 1764 - RNA, 21 nt, Artificial Sequence
  source: /note="Description of Artificial Sequence: Synthetic oligonucleotide"
cggcugcugacuuguuuacga

SEQ ID NO: 1765 - RNA, 21 nt, Artificial Sequence
  source: /note="Description of Artificial Sequence: Synthetic oligonucleotide"
ccgcugacauuuccguuguaa

SEQ ID NO: 1766 - RNA, 21 nt, Artificial Sequence
  source: /note="Description of Artificial Sequence: Synthetic oligonucleotide"
agcugguucaguuacggguua

SEQ ID NO: 1767 - RNA, 21 nt, Artificial Sequence
  source: /note="Description of Artificial Sequence: Synthetic oligonucleotide"
guggaagcgacugucucgaca

SEQ ID NO: 1768 - RNA, 21 nt, Artificial Sequence
  source: /note="Description of Artificial Sequence: Synthetic oligonucleotide"
uuuuacggaguauguucguca

SEQ ID NO: 1769 - RNA, 21 nt, Artificial Sequence
  source: /note="Description of Artificial Sequence: Synthetic oligonucleotide"
caauagagaaauaguacgaaa

SEQ ID NO: 1770 - RNA, 21 nt, Artificial Sequence
  source: /note="Description of Artificial Sequence: Synthetic oligonucleotide"
ggcaauucagucucguuguga

SEQ ID NO: 1771 - RNA, 21 nt, Artificial Sequence
  source: /note="Description of Artificial Sequence: Synthetic oligonucleotide"
agcuggugaaucggauuccua

SEQ ID NO: 1772 - RNA, 21 nt, Artificial Sequence
  source: /note="Description of Artificial Sequence: Synthetic oligonucleotide"
gucaacagcuacacacgugua

SEQ ID NO: 1773 - RNA, 21 nt, Artificial Sequence
  source: /note="Description of Artificial Sequence: Synthetic oligonucleotide"
uugagcugauguaugugacga

SEQ ID NO: 1774 - RNA, 21 nt, Artificial Sequence
  source: /note="Description of Artificial Sequence: Synthetic oligonucleotide"
ggcugcugacuuguuuacgaa

SEQ ID NO: 1775 - RNA, 21 nt, Artificial Sequence
  source: /note="Description of Artificial Sequence: Synthetic oligonucleotide"
guucaguuacggguuaauuaa

SEQ ID NO: 1776 - RNA, 21 nt, Artificial Sequence
  source: /note="Description of Artificial Sequence: Synthetic oligonucleotide"
gacugucucgacagauagcua

SEQ ID NO: 1777 - RNA, 21 nt, Artificial Sequence
  source: /note="Description of Artificial Sequence: Synthetic oligonucleotide"
uuuacggaguauguucgucaa

SEQ ID NO: 1778 - RNA, 21 nt, Artificial Sequence
  source: /note="Description of Artificial Sequence: Synthetic oligonucleotide"
aagguuucuauuacaacugga

SEQ ID NO: 1779 - RNA, 21 nt, Artificial Sequence
  source: /note="Description of Artificial Sequence: Synthetic oligonucleotide"
gacuccgagcacuuaacguga

SEQ ID NO: 1780 - RNA, 21 nt, Artificial Sequence
  source: /note="Description of Artificial Sequence: Synthetic oligonucleotide"
gcuggugaaucggauuccuga

SEQ ID NO: 1781 - RNA, 21 nt, Artificial Sequence
  source: /note="Description of Artificial Sequence: Synthetic oligonucleotide"
ucaacagcuacacacguguga

SEQ ID NO: 1782 - RNA, 21 nt, Artificial Sequence
  source: /note="Description of Artificial Sequence: Synthetic oligonucleotide"
gagcugauguaugugacgcua

SEQ ID NO: 1783 - RNA, 21 nt, Artificial Sequence
  source: /note="Description of Artificial Sequence: Synthetic oligonucleotide"
cugcugacuuguuuacgaaaa

SEQ ID NO: 1784 - RNA, 21 nt, Artificial Sequence
  source: /note="Description of Artificial Sequence: Synthetic oligonucleotide"
agcuaccaagaaagaccguga

SEQ ID NO: 1785 - RNA, 21 nt, Artificial Sequence
  source: /note="Description of Artificial Sequence: Synthetic oligonucleotide"
auucuaaucuuccaagguuaa

SEQ ID NO: 1786 - RNA, 21 nt, Artificial Sequence
  source: /note="Description of Artificial Sequence: Synthetic oligonucleotide"
agguuuaugaacugacguuaa

SEQ ID NO: 1787 - RNA, 21 nt, Artificial Sequence
  source: /note="Description of Artificial Sequence: Synthetic oligonucleotide"
aguauuguggaacuuauagca

SEQ ID NO: 1788 - RNA, 21 nt, Artificial Sequence
  source: /note="Description of Artificial Sequence: Synthetic oligonucleotide"
gacucugaaucgagaucggaa

SEQ ID NO: 1789 - RNA, 21 nt, Artificial Sequence
  source: /note="Description of Artificial Sequence: Synthetic oligonucleotide"
acagcaguguugauaaauuua

SEQ ID NO: 1790 - RNA, 21 nt, Artificial Sequence
  source: /note="Description of Artificial Sequence: Synthetic oligonucleotide"
cgccuuuuaucugcuucguua

SEQ ID NO: 1791 - RNA, 21 nt, Artificial Sequence
  source: /note="Description of Artificial Sequence: Synthetic oligonucleotide"
cugaggaacaguuccuauuga

SEQ ID NO: 1792 - RNA, 21 nt, Artificial Sequence
  source: /note="Description of Artificial Sequence: Synthetic oligonucleotide"
uaggaagagcuguaccguuga

SEQ ID NO: 1793 - RNA, 21 nt, Artificial Sequence
  source: /note="Description of Artificial Sequence: Synthetic oligonucleotide"
uucucuaagucccauccgaca

SEQ ID NO: 1794 - RNA, 21 nt, Artificial Sequence
  source: /note="Description of Artificial Sequence: Synthetic oligonucleotide"
cuaccaagaaagaccguguga

SEQ ID NO: 1795 - RNA, 21 nt, Artificial Sequence
  source: /note="Description of Artificial Sequence: Synthetic oligonucleotide"
uuccaagguuacagcucgaga

SEQ ID NO: 1796 - RNA, 21 nt, Artificial Sequence
  source: /note="Description of Artificial Sequence: Synthetic oligonucleotide"
gguuuaugaacugacguuaca

SEQ ID NO: 1797 - RNA, 21 nt, Artificial Sequence
  source: /note="Description of Artificial Sequence: Synthetic oligonucleotide"
guauuguggaacuuauagcua

SEQ ID NO: 1798 - RNA, 21 nt, Artificial Sequence
  source: /note="Description of Artificial Sequence: Synthetic oligonucleotide"
acucugaaucgagaucggaua

SEQ ID NO: 1799 - RNA, 21 nt, Artificial Sequence
  source: /note="Description of Artificial Sequence: Synthetic oligonucleotide"
ugauaaauuuguguugagaga

SEQ ID NO: 1800 - RNA, 21 nt, Artificial Sequence
  source: /note="Description of Artificial Sequence: Synthetic oligonucleotide"
ugaggaacaguuccuauugga

SEQ ID NO: 1801 - RNA, 21 nt, Artificial Sequence
  source: /note="Description of Artificial Sequence: Synthetic oligonucleotide"
ucuccgucagcacaauaacca

SEQ ID NO: 1802 - RNA, 21 nt, Artificial Sequence
  source: /note="Description of Artificial Sequence: Synthetic oligonucleotide"
aggaagagcuguaccguugga

SEQ ID NO: 1803 - RNA, 21 nt, Artificial Sequence
  source: /note="Description of Artificial Sequence: Synthetic oligonucleotide"
gagaacaagcaucuguaccga

SEQ ID NO: 1804 - RNA, 21 nt, Artificial Sequence
  source: /note="Description of Artificial Sequence: Synthetic oligonucleotide"
gagugucacaaagaaccguga

SEQ ID NO: 1805 - RNA, 21 nt, Artificial Sequence
  source: /note="Description of Artificial Sequence: Synthetic oligonucleotide"
aaucauugucugacaauauga

SEQ ID NO: 1806 - RNA, 21 nt, Artificial Sequence
  source: /note="Description of Artificial Sequence: Synthetic oligonucleotide"
uccaagguuacagcucgagca

SEQ ID NO: 1807 - RNA, 21 nt, Artificial Sequence
  source: /note="Description of Artificial Sequence: Synthetic oligonucleotide"
uuuaugaacugacguuacaua

SEQ ID NO: 1808 - RNA, 21 nt, Artificial Sequence
  source: /note="Description of Artificial Sequence: Synthetic oligonucleotide"
uauuguggaacuuauagcuga

SEQ ID NO: 1809 - RNA, 21 nt, Artificial Sequence
  source: /note="Description of Artificial Sequence: Synthetic oligonucleotide"
cucugaaucgagaucggauga

SEQ ID NO: 1810 - RNA, 21 nt, Artificial Sequence
  source: /note="Description of Artificial Sequence: Synthetic oligonucleotide"
agaugaagcuacugaaccgga

SEQ ID NO: 1811 - RNA, 21 nt, Artificial Sequence
  source: /note="Description of Artificial Sequence: Synthetic oligonucleotide"
caucuugaacuacaucgauca

SEQ ID NO: 1812 - RNA, 21 nt, Artificial Sequence
  source: /note="Description of Artificial Sequence: Synthetic oligonucleotide"
uccgucagcacaauaaccaga

SEQ ID NO: 1813 - RNA, 21 nt, Artificial Sequence
  source: /note="Description of Artificial Sequence: Synthetic oligonucleotide"
ggaagagcuguaccguuggga

SEQ ID NO: 1814 - RNA, 21 nt, Artificial Sequence
  source: /note="Description of Artificial Sequence: Synthetic oligonucleotide"
ugucacaaagaaccgugcaga

SEQ ID NO: 1815 - RNA, 21 nt, Artificial Sequence
  source: /note="Description of Artificial Sequence: Synthetic oligonucleotide"
cuguucccaaaauuauggcua

SEQ ID NO: 1816 - RNA, 21 nt, Artificial Sequence
  source: /note="Description of Artificial Sequence: Synthetic oligonucleotide"
cagcaccaagaccacaaugua

SEQ ID NO: 1817 - RNA, 21 nt, Artificial Sequence
  source: /note="Description of Artificial Sequence: Synthetic oligonucleotide"
auuguggaacuuauagcugga

SEQ ID NO: 1818 - RNA, 21 nt, Artificial Sequence
  source: /note="Description of Artificial Sequence: Synthetic oligonucleotide"
uucugaaauuguguuagacga

SEQ ID NO: 1819 - RNA, 21 nt, Artificial Sequence
  source: /note="Description of Artificial Sequence: Synthetic oligonucleotide"
ccucuuguccauuguguccga

SEQ ID NO: 1820 - RNA, 21 nt, Artificial Sequence
  source: /note="Description of Artificial Sequence: Synthetic oligonucleotide"
cuugaacuacaucgaucauga

SEQ ID NO: 1821 - RNA, 21 nt, Artificial Sequence
  source: /note="Description of Artificial Sequence: Synthetic oligonucleotide"
aagaacgagugcucaauaaua

SEQ ID NO: 1822 - RNA, 21 nt, Artificial Sequence
  source: /note="Description of Artificial Sequence: Synthetic oligonucleotide"
aaccuuucaagaguuauugca

SEQ ID NO: 1823 - RNA, 21 nt, Artificial Sequence
  source: /note="Description of Artificial Sequence: Synthetic oligonucleotide"
gucagcuugguucccauugga

SEQ ID NO: 1824 - RNA, 21 nt, Artificial Sequence
  source: /note="Description of Artificial Sequence: Synthetic oligonucleotide"
ccugaaauccugcuuuaguca

SEQ ID NO: 1825 - RNA, 21 nt, Artificial Sequence
  source: /note="Description of Artificial Sequence: Synthetic oligonucleotide"
uaagaaugcuauucauaauca

SEQ ID NO: 1826 - RNA, 21 nt, Artificial Sequence
  source: /note="Description of Artificial Sequence: Synthetic oligonucleotide"
aaugccucaacaaaguuauca

SEQ ID NO: 1827 - RNA, 21 nt, Artificial Sequence
  source: /note="Description of Artificial Sequence: Synthetic oligonucleotide"
aggccuucauagcgaaccuga

SEQ ID NO: 1828 - RNA, 21 nt, Artificial Sequence
  source: /note="Description of Artificial Sequence: Synthetic oligonucleotide"
gcaccaagaccacaauguuga

SEQ ID NO: 1829 - RNA, 21 nt, Artificial Sequence
  source: /note="Description of Artificial Sequence: Synthetic oligonucleotide"
uggaggaugacucugaaucga

SEQ ID NO: 1830 - RNA, 21 nt, Artificial Sequence
  source: /note="Description of Artificial Sequence: Synthetic oligonucleotide"
ucugaaauuguguuagacgga

SEQ ID NO: 1831 - RNA, 21 nt, Artificial Sequence
  source: /note="Description of Artificial Sequence: Synthetic oligonucleotide"
cucuuguccauuguguccgca

SEQ ID NO: 1832 - RNA, 21 nt, Artificial Sequence
  source: /note="Description of Artificial Sequence: Synthetic oligonucleotide"
gagugcucaauaauguuguca

SEQ ID NO: 1833 - RNA, 21 nt, Artificial Sequence
  source: /note="Description of Artificial Sequence: Synthetic oligonucleotide"
aguuugcauuuggaguuuaga

SEQ ID NO: 1834 - RNA, 21 nt, Artificial Sequence
  source: /note="Description of Artificial Sequence: Synthetic oligonucleotide"
agcuugguucccauuggauca

SEQ ID NO: 1835 - RNA, 21 nt, Artificial Sequence
  source: /note="Description of Artificial Sequence: Synthetic oligonucleotide"
cugaaauccugcuuuagucga

SEQ ID NO: 1836 - RNA, 21 nt, Artificial Sequence
  source: /note="Description of Artificial Sequence: Synthetic oligonucleotide"
uuaucaaagcuuugauggaua

SEQ ID NO: 1837 - RNA, 21 nt, Artificial Sequence
  source: /note="Description of Artificial Sequence: Synthetic oligonucleotide"
cucugcugauucuuggcguga

SEQ ID NO: 1838 - RNA, 21 nt, Artificial Sequence
  source: /note="Description of Artificial Sequence: Synthetic oligonucleotide"
caccaagaccacaauguugua

SEQ ID NO: 1839 - RNA, 21 nt, Artificial Sequence
  source: /note="Description of Artificial Sequence: Synthetic oligonucleotide"
gaggaugacucugaaucgaga

SEQ ID NO: 1840 - RNA, 21 nt, Artificial Sequence
  source: /note="Description of Artificial Sequence: Synthetic oligonucleotide"
uccgccuuuuaucugcuucga

SEQ ID NO: 1841 - RNA, 21 nt, Artificial Sequence
  source: /note="Description of Artificial Sequence: Synthetic oligonucleotide"
gaacuacaucgaucauggaga

SEQ ID NO: 1842 - RNA, 21 nt, Artificial Sequence
  source: /note="Description of Artificial Sequence: Synthetic oligonucleotide"
gccuccaucucauuucuccga

SEQ ID NO: 1843 - RNA, 21 nt, Artificial Sequence
  source: /note="Description of Artificial Sequence: Synthetic oligonucleotide"
guuugcauuuggaguuuagga

SEQ ID NO: 1844 - RNA, 21 nt, Artificial Sequence
  source: /note="Description of Artificial Sequence: Synthetic oligonucleotide"
agaugcuuugauuuuggccga

SEQ ID NO: 1845 - RNA, 21 nt, Artificial Sequence
  source: /note="Description of Artificial Sequence: Synthetic oligonucleotide"
gaaauccugcuuuagucgaga

SEQ ID NO: 1846 - RNA, 21 nt, Artificial Sequence
  source: /note="Description of Artificial Sequence: Synthetic oligonucleotide"
gcuauucauaaucacauucga

SEQ ID NO: 1847 - RNA, 21 nt, Artificial Sequence
  source: /note="Description of Artificial Sequence: Synthetic oligonucleotide"
gcuuugauggauucuaaucua

SEQ ID NO: 1848 - RNA, 21 nt, Artificial Sequence
  source: /note="Description of Artificial Sequence: Synthetic oligonucleotide"
gcagcuuguccagguuuauga

SEQ ID NO: 1849 - RNA, 21 nt, Artificial Sequence
  source: /note="Description of Artificial Sequence: Synthetic oligonucleotide"
accaagaccacaauguuguga

SEQ ID NO: 1850 - RNA, 21 nt, Artificial Sequence
  source: /note="Description of Artificial Sequence: Synthetic oligonucleotide"
aggaugacucugaaucgagaa

SEQ ID NO: 1851 - RNA, 21 nt, Artificial Sequence
  source: /note="Description of Artificial Sequence: Synthetic oligonucleotide"
ugaaauuguguuagacgguaa

SEQ ID NO: 1852 - RNA, 21 nt, Artificial Sequence
  source: /note="Description of Artificial Sequence: Synthetic oligonucleotide"
ccgccuuuuaucugcuucgua

SEQ ID NO: 1853 - RNA, 21 nt, Artificial Sequence
  source: /note="Description of Artificial Sequence: Synthetic oligonucleotide"
cuuuggcggauugcauuccua

SEQ ID NO: 1854 - RNA, 21 nt, Artificial Sequence
  source: /note="Description of Artificial Sequence: Synthetic oligonucleotide"
ccuccaucucauuucuccgua

SEQ ID NO: 1855 - RNA, 21 nt, Artificial Sequence
  source: /note="Description of Artificial Sequence: Synthetic oligonucleotide"
gucuaggaagagcuguaccga

SEQ ID NO: 1856 - RNA, 21 nt, Artificial Sequence
  source: /note="Description of Artificial Sequence: Synthetic oligonucleotide"
ggccggaaacuugcuugcaga

SEQ ID NO: 1857 - RNA, 21 nt, Artificial Sequence
  source: /note="Description of Artificial Sequence: Synthetic oligonucleotide"
uuuagucgagaaccaaugaua

SEQ ID NO: 1858 - RNA, 21 nt, Artificial Sequence
  source: /note="Description of Artificial Sequence: Synthetic oligonucleotide"
uucauaaucacauucguuuga

SEQ ID NO: 1859 - RNA, 21 nt, Artificial Sequence
  source: /note="Description of Artificial Sequence: Synthetic oligonucleotide"
gaguauuguggaacuuauaga

SEQ ID NO: 1860 - RNA, 21 nt, Artificial Sequence
  source: /note="Description of Artificial Sequence: Synthetic oligonucleotide"
ggaugacucugaaucgagaua

SEQ ID NO: 1861 - RNA, 21 nt, Artificial Sequence
  source: /note="Description of Artificial Sequence: Synthetic oligonucleotide"
gaaauuguguuagacgguaca

SEQ ID NO: 1862 - RNA, 21 nt, Artificial Sequence
  source: /note="Description of Artificial Sequence: Synthetic oligonucleotide"
uuuggcggauugcauuccuua

SEQ ID NO: 1863 - RNA, 21 nt, Artificial Sequence
  source: /note="Description of Artificial Sequence: Synthetic oligonucleotide"
cuccaucucauuucuccguca

SEQ ID NO: 1864 - RNA, 21 nt, Artificial Sequence
  source: /note="Description of Artificial Sequence: Synthetic oligonucleotide"
ucuaggaagagcuguaccgua

SEQ ID NO: 1865 - RNA, 21 nt, Artificial Sequence
  source: /note="Description of Artificial Sequence: Synthetic oligonucleotide"
cuucucuaagucccauccgaa

SEQ ID NO: 1866 - RNA, 21 nt, Artificial Sequence
  source: /note="Description of Artificial Sequence: Synthetic oligonucleotide"
uuagucgagaaccaaugauga

SEQ ID NO: 1867 - RNA, 23 nt, Artificial Sequence
  source: /note="Description of Artificial Sequence: Synthetic oligonucleotide"
uacaaacgaaugugauuaugaau

SEQ ID NO: 1868 - RNA, 23 nt, Artificial Sequence
  source: /note="Description of Artificial Sequence: Synthetic oligonucleotide"
uguaauuaacccguaacugaacc

SEQ ID NO: 1869 - RNA, 23 nt, Artificial Sequence
  source: /note="Description of Artificial Sequence: Synthetic oligonucleotide"
ucagcuaucugucgagacagucg

SEQ ID NO: 1870 - RNA, 23 nt, Artificial Sequence
  source: /note="Description of Artificial Sequence: Synthetic oligonucleotide"
ugugacgaacauacuccguaaaa

SEQ ID NO: 1871 - RNA, 23 nt, Artificial Sequence
  source: /note="Description of Artificial Sequence: Synthetic oligonucleotide"
uggcaauagaaaguauguugcug

SEQ ID NO: 1872 - RNA, 23 nt, Artificial Sequence
  source: /note="Description of Artificial Sequence: Synthetic oligonucleotide"
uccacguuaagugcucggaguca

SEQ ID NO: 1873 - RNA, 23 nt, Artificial Sequence
  source: /note="Description of Artificial Sequence: Synthetic oligonucleotide"
uucacaacgagacugaauugccu

SEQ ID NO: 1874 - RNA, 23 nt, Artificial Sequence
  source: /note="Description of Artificial Sequence: Synthetic oligonucleotide"
uccgaguucaucaugaaggcauu

SEQ ID NO: 1875 - RNA, 23 nt, Artificial Sequence
  source: /note="Description of Artificial Sequence: Synthetic oligonucleotide"
ugcacacguguguagcuguugac

SEQ ID NO: 1876 - RNA, 23 nt, Artificial Sequence
  source: /note="Description of Artificial Sequence: Synthetic oligonucleotide"
uuucgcaguucugucagcgucac

SEQ ID NO: 1877 - RNA, 23 nt, Artificial Sequence
  source: /note="Description of Artificial Sequence: Synthetic oligonucleotide"
uacauuucguaaacaagucagca

SEQ ID NO: 1878 - RNA, 23 nt, Artificial Sequence
  source: /note="Description of Artificial Sequence: Synthetic oligonucleotide"
uuucaaacaaacgaaugugauua

SEQ ID NO: 1879 - RNA, 23 nt, Artificial Sequence
  source: /note="Description of Artificial Sequence: Synthetic oligonucleotide"
ucaguaauuaacccguaacugaa

SEQ ID NO: 1880 - RNA, 23 nt, Artificial Sequence
  source: /note="Description of Artificial Sequence: Synthetic oligonucleotide"
uauuuaacacuccaagggcuuca

SEQ ID NO: 1881 - RNA, 23 nt, Artificial Sequence
  source: /note="Description of Artificial Sequence: Synthetic oligonucleotide"
ucaguugacugggaaaucagaac

SEQ ID NO: 1882 - RNA, 23 nt, Artificial Sequence
  source: /note="Description of Artificial Sequence: Synthetic oligonucleotide"
uaacauuccagacuugaagaugu

SEQ ID NO: 1883 - RNA, 23 nt, Artificial Sequence
  source: /note="Description of Artificial Sequence: Synthetic oligonucleotide"
ucgagacugaauugccuggauga

SEQ ID NO: 1884 - RNA, 23 nt, Artificial Sequence
  source: /note="Description of Artificial Sequence: Synthetic oligonucleotide"
ucaagcaaggaugucgaccaugc

SEQ ID NO: 1885 - RNA, 23 nt, Artificial Sequence
  source: /note="Description of Artificial Sequence: Synthetic oligonucleotide"
uacuccgaguucaucaugaaggc

SEQ ID NO: 1886 - RNA, 23 nt, Artificial Sequence
  source: /note="Description of Artificial Sequence: Synthetic oligonucleotide"
ucaaacugaguacgacuggucca

SEQ ID NO: 1887 - RNA, 23 nt, Artificial Sequence
  source: /note="Description of Artificial Sequence: Synthetic oligonucleotide"
ucuucgcaguucugucagcguca

SEQ ID NO: 1888 - RNA, 23 nt, Artificial Sequence
  source: /note="Description of Artificial Sequence: Synthetic oligonucleotide"
ugacauuucguaaacaagucagc

SEQ ID NO: 1889 - RNA, 23 nt, Artificial Sequence
  source: /note="Description of Artificial Sequence: Synthetic oligonucleotide"
uccaauaaacaccugaucugaau

SEQ ID NO: 1890 - RNA, 23 nt, Artificial Sequence
  source: /note="Description of Artificial Sequence: Synthetic oligonucleotide"
uguauuuaacacuccaagggcuu

SEQ ID NO: 1891 - RNA, 23 nt, Artificial Sequence
  source: /note="Description of Artificial Sequence: Synthetic oligonucleotide"
uccggaacauuccagacuugaag

SEQ ID NO: 1892 - RNA, 23 nt, Artificial Sequence
  source: /note="Description of Artificial Sequence: Synthetic oligonucleotide"
uacgagacugaauugccuggaug

SEQ ID NO: 1893 - RNA, 23 nt, Artificial Sequence
  source: /note="Description of Artificial Sequence: Synthetic oligonucleotide"
ucgacaagcaaggaugucgacca

SEQ ID NO: 1894 - RNA, 23 nt, Artificial Sequence
  source: /note="Description of Artificial Sequence: Synthetic oligonucleotide"
ucuuaagcauggagcuagcaggc

SEQ ID NO: 1895 - RNA, 23 nt, Artificial Sequence
  source: /note="Description of Artificial Sequence: Synthetic oligonucleotide"
uucaaacugaguacgacuggucc

SEQ ID NO: 1896 - RNA, 23 nt, Artificial Sequence
  source: /note="Description of Artificial Sequence: Synthetic oligonucleotide"
ucggacugacuuucuccuuuccu

SEQ ID NO: 1897 - RNA, 23 nt, Artificial Sequence
  source: /note="Description of Artificial Sequence: Synthetic oligonucleotide"
ugcauagaaagaguuacguuaaa

SEQ ID NO: 1898 - RNA, 23 nt, Artificial Sequence
  source: /note="Description of Artificial Sequence: Synthetic oligonucleotide"
ucuguuucaauacaaagccaaua

SEQ ID NO: 1899 - RNA, 23 nt, Artificial Sequence
  source: /note="Description of Artificial Sequence: Synthetic oligonucleotide"
uacuccguaaaagcaugucuacc

SEQ ID NO: 1900 - RNA, 23 nt, Artificial Sequence
  source: /note="Description of Artificial Sequence: Synthetic oligonucleotide"
uauacgagaaagaacaauaucuu

SEQ ID NO: 1901 - RNA, 23 nt, Artificial Sequence
  source: /note="Description of Artificial Sequence: Synthetic oligonucleotide"
uuccggaacauuccagacuugaa

SEQ ID NO: 1902 - RNA, 23 nt, Artificial Sequence
  source: /note="Description of Artificial Sequence: Synthetic oligonucleotide"
uaacgagacugaauugccuggau

SEQ ID NO: 1903 - RNA, 23 nt, Artificial Sequence
  source: /note="Description of Artificial Sequence: Synthetic oligonucleotide"
ugacuaagugagucuugcauggu

SEQ ID NO: 1904 - RNA, 23 nt, Artificial Sequence
  source: /note="Description of Artificial Sequence: Synthetic oligonucleotide"
ugcuuaagcauggagcuagcagg

SEQ ID NO: 1905 - RNA, 23 nt, Artificial Sequence
  source: /note="Description of Artificial Sequence: Synthetic oligonucleotide"
uuucaaacugaguacgacugguc

SEQ ID NO: 1906 - RNA, 23 nt, Artificial Sequence
  source: /note="Description of Artificial Sequence: Synthetic oligonucleotide"
uggauuagggucugaaguucuac

SEQ ID NO: 1907 - RNA, 23 nt, Artificial Sequence
  source: /note="Description of Artificial Sequence: Synthetic oligonucleotide"
uauacuuuacacgggcauagaaa

SEQ ID NO: 1908 - RNA, 23 nt, Artificial Sequence
  source: /note="Description of Artificial Sequence: Synthetic oligonucleotide"
uuugaaugauagcguucauaaga

SEQ ID NO: 1909 - RNA, 23 nt, Artificial Sequence
  source: /note="Description of Artificial Sequence: Synthetic oligonucleotide"
ucauacuccguaaaagcaugucu

SEQ ID NO: 1910 - RNA, 23 nt, Artificial Sequence
  source: /note="Description of Artificial Sequence: Synthetic oligonucleotide"
ucugaauacgagaaagaacaaua

SEQ ID NO: 1911 - RNA, 23 nt, Artificial Sequence
  source: /note="Description of Artificial Sequence: Synthetic oligonucleotide"
uggacuaaguaacuuugugcugg

SEQ ID NO: 1912 - RNA, 23 nt, Artificial Sequence
  source: /note="Description of Artificial Sequence: Synthetic oligonucleotide"
ucaacgagacugaauugccugga

SEQ ID NO: 1913 - RNA, 23 nt, Artificial Sequence
  source: /note="Description of Artificial Sequence: Synthetic oligonucleotide"
uggacuaagugagucuugcaugg

SEQ ID NO: 1914 - RNA, 23 nt, Artificial Sequence
  source: /note="Description of Artificial Sequence: Synthetic oligonucleotide"
uaucauucaacuugcuccaguag

SEQ ID NO: 1915 - RNA, 23 nt, Artificial Sequence
  source: /note="Description of Artificial Sequence: Synthetic oligonucleotide"
uuccgaugacuuuguucaugaug

SEQ ID NO: 1916 - RNA, 23 nt, Artificial Sequence
  source: /note="Description of Artificial Sequence: Synthetic oligonucleotide"
ucauacuuuacacgggcauagaa

SEQ ID NO: 1917 - RNA, 23 nt, Artificial Sequence
  source: /note="Description of Artificial Sequence: Synthetic oligonucleotide"
ucguguacuguuuuaaagcuuuu

SEQ ID NO: 1918 - RNA, 23 nt, Artificial Sequence
  source: /note="Description of Artificial Sequence: Synthetic oligonucleotide"
ucuguuuugaaugauagcguuca

SEQ ID NO: 1919 - RNA, 23 nt, Artificial Sequence
  source: /note="Description of Artificial Sequence: Synthetic oligonucleotide"
uacgaacauacuccguaaaagca

SEQ ID NO: 1920 - RNA, 23 nt, Artificial Sequence
  source: /note="Description of Artificial Sequence: Synthetic oligonucleotide"
uccaagucagaauccuccucuuc

SEQ ID NO: 1921 - RNA, 23 nt, Artificial Sequence
  source: /note="Description of Artificial Sequence: Synthetic oligonucleotide"
uacaacgagacugaauugccugg

SEQ ID NO: 1922 - RNA, 23 nt, Artificial Sequence
  source: /note="Description of Artificial Sequence: Synthetic oligonucleotide"
ucggacucacuguuuccagugac

SEQ ID NO: 1923 - RNA, 23 nt, Artificial Sequence
  source: /note="Description of Artificial Sequence: Synthetic oligonucleotide"
ucacguguguagcuguugacaag

SEQ ID NO: 1924 - RNA, 23 nt, Artificial Sequence
  source: /note="Description of Artificial Sequence: Synthetic oligonucleotide"
uccucugauaaugcucagcuucc

SEQ ID NO: 1925 - RNA, 23 nt, Artificial Sequence
  source: /note="Description of Artificial Sequence: Synthetic oligonucleotide"
ucguaaacaagucagcagccggu

SEQ ID NO: 1926 - RNA, 23 nt, Artificial Sequence
  source: /note="Description of Artificial Sequence: Synthetic oligonucleotide"
uuacaacggaaaugucagcgggu

SEQ ID NO: 1927 - RNA, 23 nt, Artificial Sequence
  source: /note="Description of Artificial Sequence: Synthetic oligonucleotide"
uaacccguaacugaaccagcugc

SEQ ID NO: 1928 - RNA, 23 nt, Artificial Sequence
  source: /note="Description of Artificial Sequence: Synthetic oligonucleotide"
ugucgagacagucgcuuccacuu

SEQ ID NO: 1929 - RNA, 23 nt, Artificial Sequence
  source: /note="Description of Artificial Sequence: Synthetic oligonucleotide"
ugacgaacauacuccguaaaagc

SEQ ID NO: 1930 - RNA, 23 nt, Artificial Sequence
  source: /note="Description of Artificial Sequence: Synthetic oligonucleotide"
uuucguacuauuucucuauugca

SEQ ID NO: 1931 - RNA, 23 nt, Artificial Sequence
  source: /note="Description of Artificial Sequence: Synthetic oligonucleotide"
ucacaacgagacugaauugccug

SEQ ID NO: 1932 - RNA, 23 nt, Artificial Sequence
  source: /note="Description of Artificial Sequence: Synthetic oligonucleotide"
uaggaauccgauucaccagcucu

SEQ ID NO: 1933 - RNA, 23 nt, Artificial Sequence
  source: /note="Description of Artificial Sequence: Synthetic oligonucleotide"
uacacguguguagcuguugacaa

SEQ ID NO: 1934 - RNA, 23 nt, Artificial Sequence
  source: /note="Description of Artificial Sequence: Synthetic oligonucleotide"
ucgucacauacaucagcucaaac

SEQ ID NO: 1935 - RNA, 23 nt, Artificial Sequence
  source: /note="Description of Artificial Sequence: Synthetic oligonucleotide"
uucguaaacaagucagcagccgg

SEQ ID NO: 1936 - RNA, 23 nt, Artificial Sequence
  source: /note="Description of Artificial Sequence: Synthetic oligonucleotide"
uuaauuaacccguaacugaacca

SEQ ID NO: 1937 - RNA, 23 nt, Artificial Sequence
  source: /note="Description of Artificial Sequence: Synthetic oligonucleotide"
uagcuaucugucgagacagucgc

SEQ ID NO: 1938 - RNA, 23 nt, Artificial Sequence
  source: /note="Description of Artificial Sequence: Synthetic oligonucleotide"
uugacgaacauacuccguaaaag

SEQ ID NO: 1939 - RNA, 23 nt, Artificial Sequence
  source: /note="Description of Artificial Sequence: Synthetic oligonucleotide"
uccaguuguaauagaaaccuuga

SEQ ID NO: 1940 - RNA, 23 nt, Artificial Sequence
  source: /note="Description of Artificial Sequence: Synthetic oligonucleotide"
ucacguuaagugcucggagucau

SEQ ID NO: 1941 - RNA, 23 nt, Artificial Sequence
  source: /note="Description of Artificial Sequence: Synthetic oligonucleotide"
ucaggaauccgauucaccagcuc

SEQ ID NO: 1942 - RNA, 23 nt, Artificial Sequence
  source: /note="Description of Artificial Sequence: Synthetic oligonucleotide"
ucacacguguguagcuguugaca

SEQ ID NO: 1943 - RNA, 23 nt, Artificial Sequence
  source: /note="Description of Artificial Sequence: Synthetic oligonucleotide"
uagcgucacauacaucagcucaa

SEQ ID NO: 1944 - RNA, 23 nt, Artificial Sequence
  source: /note="Description of Artificial Sequence: Synthetic oligonucleotide"
uuuucguaaacaagucagcagcc

SEQ ID NO: 1945 - RNA, 23 nt, Artificial Sequence
  source: /note="Description of Artificial Sequence: Synthetic oligonucleotide"
ucacggucuuucuugguagcuga

SEQ ID NO: 1946 - RNA, 23 nt, Artificial Sequence
  source: /note="Description of Artificial Sequence: Synthetic oligonucleotide"
uuaaccuuggaagauuagaaucc

SEQ ID NO: 1947 - RNA, 23 nt, Artificial Sequence
  source: /note="Description of Artificial Sequence: Synthetic oligonucleotide"
uuaacgucaguucauaaaccugg

SEQ ID NO: 1948 - RNA, 23 nt, Artificial Sequence
  source: /note="Description of Artificial Sequence: Synthetic oligonucleotide"
ugcuauaaguuccacaauacucc

SEQ ID NO: 1949 - RNA, 23 nt, Artificial Sequence
  source: /note="Description of Artificial Sequence: Synthetic oligonucleotide"
uuccgaucucgauucagagucau

SEQ ID NO: 1950 - RNA, 23 nt, Artificial Sequence
  source: /note="Description of Artificial Sequence: Synthetic oligonucleotide"
uaaauuuaucaacacugcuguca

SEQ ID NO: 1951 - RNA, 23 nt, Artificial Sequence
  source: /note="Description of Artificial Sequence: Synthetic oligonucleotide"
uaacgaagcagauaaaaggcgga

SEQ ID NO: 1952 - RNA, 23 nt, Artificial Sequence
  source: /note="Description of Artificial Sequence: Synthetic oligonucleotide"
ucaauaggaacuguuccucagag

SEQ ID NO: 1953 - RNA, 23 nt, Artificial Sequence
  source: /note="Description of Artificial Sequence: Synthetic oligonucleotide"
ucaacgguacagcucuuccuaga

SEQ ID NO: 1954 - RNA, 23 nt, Artificial Sequence
  source: /note="Description of Artificial Sequence: Synthetic oligonucleotide"
ugucggaugggacuuagagaagg

SEQ ID NO: 1955 - RNA, 23 nt, Artificial Sequence
  source: /note="Description of Artificial Sequence: Synthetic oligonucleotide"
ucacacggucuuucuugguagcu

SEQ ID NO: 1956 - RNA, 23 nt, Artificial Sequence
  source: /note="Description of Artificial Sequence: Synthetic oligonucleotide"
ucucgagcuguaaccuuggaaga

SEQ ID NO: 1957 - RNA, 23 nt, Artificial Sequence
  source: /note="Description of Artificial Sequence: Synthetic oligonucleotide"
uguaacgucaguucauaaaccug

SEQ ID NO: 1958 - RNA, 23 nt, Artificial Sequence
  source: /note="Description of Artificial Sequence: Synthetic oligonucleotide"
uagcuauaaguuccacaauacuc

SEQ ID NO: 1959 - RNA, 23 nt, Artificial Sequence
  source: /note="Description of Artificial Sequence: Synthetic oligonucleotide"
uauccgaucucgauucagaguca

SEQ ID NO: 1960 - RNA, 23 nt, Artificial Sequence
  source: /note="Description of Artificial Sequence: Synthetic oligonucleotide"
ucucucaacacaaauuuaucaac

SEQ ID NO: 1961 - RNA, 23 nt, Artificial Sequence
  source: /note="Description of Artificial Sequence: Synthetic oligonucleotide"
uccaauaggaacuguuccucaga

SEQ ID NO: 1962 - RNA, 23 nt, Artificial Sequence
  source: /note="Description of Artificial Sequence: Synthetic oligonucleotide"
ugguuauugugcugacggagaaa

SEQ ID NO: 1963 - RNA, 23 nt, Artificial Sequence
  source: /note="Description of Artificial Sequence: Synthetic oligonucleotide"
uccaacgguacagcucuuccuag

SEQ ID NO: 1964 - RNA, 23 nt, Artificial Sequence
  source: /note="Description of Artificial Sequence: Synthetic oligonucleotide"
ucgguacagaugcuuguucuccu

SEQ ID NO: 1965 - RNA, 23 nt, Artificial Sequence
  source: /note="Description of Artificial Sequence: Synthetic oligonucleotide"
ucacgguucuuugugacacucgu

SEQ ID NO: 1966 - RNA, 23 nt, Artificial Sequence
  source: /note="Description of Artificial Sequence: Synthetic oligonucleotide"
ucauauugucagacaaugauuca

SEQ ID NO: 1967 - RNA, 23 nt, Artificial Sequence
  source: /note="Description of Artificial Sequence: Synthetic oligonucleotide"
ugcucgagcuguaaccuuggaag

SEQ ID NO: 1968 - RNA, 23 nt, Artificial Sequence
  source: /note="Description of Artificial Sequence: Synthetic oligonucleotide"
uauguaacgucaguucauaaacc

SEQ ID NO: 1969 - RNA, 23 nt, Artificial Sequence
  source: /note="Description of Artificial Sequence: Synthetic oligonucleotide"
ucagcuauaaguuccacaauacu

SEQ ID NO: 1970 - RNA, 23 nt, Artificial Sequence
  source: /note="Description of Artificial Sequence: Synthetic oligonucleotide"
ucauccgaucucgauucagaguc

SEQ ID NO: 1971 - RNA, 23 nt, Artificial Sequence
  source: /note="Description of Artificial Sequence: Synthetic oligonucleotide"
uccgguucaguagcuucaucucu

SEQ ID NO: 1972 - RNA, 23 nt, Artificial Sequence
  source: /note="Description of Artificial Sequence: Synthetic oligonucleotide"
ugaucgauguaguucaagauguc

SEQ ID NO: 1973 - RNA, 23 nt, Artificial Sequence
  source: /note="Description of Artificial Sequence: Synthetic oligonucleotide"
ucugguuauugugcugacggaga

SEQ ID NO: 1974 - RNA, 23 nt, Artificial Sequence
  source: /note="Description of Artificial Sequence: Synthetic oligonucleotide"
ucccaacgguacagcucuuccua

SEQ ID NO: 1975 - RNA, 23 nt, Artificial Sequence
  source: /note="Description of Artificial Sequence: Synthetic oligonucleotide"
ucugcacgguucuuugugacacu

SEQ ID NO: 1976 - RNA, 23 nt, Artificial Sequence
  source: /note="Description of Artificial Sequence: Synthetic oligonucleotide"
uucacauauugucagacaaugau

SEQ ID NO: 1977 - RNA, 23 nt, Artificial Sequence
  source: /note="Description of Artificial Sequence: Synthetic oligonucleotide"
uagccauaauuuugggaacagcu

SEQ ID NO: 1978 - RNA, 23 nt, Artificial Sequence
  source: /note="Description of Artificial Sequence: Synthetic oligonucleotide"
uacauuguggucuuggugcugug

SEQ ID NO: 1979 - RNA, 23 nt, Artificial Sequence
  source: /note="Description of Artificial Sequence: Synthetic oligonucleotide"
uccagcuauaaguuccacaauac

SEQ ID NO: 1980 - RNA, 23 nt, Artificial Sequence
  source: /note="Description of Artificial Sequence: Synthetic oligonucleotide"
ucgucuaacacaauuucagaacu

SEQ ID NO: 1981 - RNA, 23 nt, Artificial Sequence
  source: /note="Description of Artificial Sequence: Synthetic oligonucleotide"
ucggacacaauggacaagaggug

SEQ ID NO: 1982 - RNA, 23 nt, Artificial Sequence
  source: /note="Description of Artificial Sequence: Synthetic oligonucleotide"
ucaugaucgauguaguucaagau

SEQ ID NO: 1983 - RNA, 23 nt, Artificial Sequence
  source: /note="Description of Artificial Sequence: Synthetic oligonucleotide"
uauuauugagcacucguucuugc

SEQ ID NO: 1984 - RNA, 23 nt, Artificial Sequence
  source: /note="Description of Artificial Sequence: Synthetic oligonucleotide"
ugcaauaacucuugaaagguuau

SEQ ID NO: 1985 - RNA, 23 nt, Artificial Sequence
  source: /note="Description of Artificial Sequence: Synthetic oligonucleotide"
uccaaugggaaccaagcugacga

SEQ ID NO: 1986 - RNA, 23 nt, Artificial Sequence
  source: /note="Description of Artificial Sequence: Synthetic oligonucleotide"
ugacuaaagcaggauuucaggua

SEQ ID NO: 1987 - RNA, 23 nt, Artificial Sequence
  source: /note="Description of Artificial Sequence: Synthetic oligonucleotide"
ugauuaugaauagcauucuuauc

SEQ ID NO: 1988 - RNA, 23 nt, Artificial Sequence
  source: /note="Description of Artificial Sequence: Synthetic oligonucleotide"
ugauaacuuuguugaggcauucg

SEQ ID NO: 1989 - RNA, 23 nt, Artificial Sequence
  source: /note="Description of Artificial Sequence: Synthetic oligonucleotide"
ucagguucgcuaugaaggccuuu

SEQ ID NO: 1990 - RNA, 23 nt, Artificial Sequence
  source: /note="Description of Artificial Sequence: Synthetic oligonucleotide"
ucaacauuguggucuuggugcug

SEQ ID NO: 1991 - RNA, 23 nt, Artificial Sequence
  source: /note="Description of Artificial Sequence: Synthetic oligonucleotide"
ucgauucagagucauccuccaag

SEQ ID NO: 1992 - RNA, 23 nt, Artificial Sequence
  source: /note="Description of Artificial Sequence: Synthetic oligonucleotide"
uccgucuaacacaauuucagaac

SEQ ID NO: 1993 - RNA, 23 nt, Artificial Sequence
  source: /note="Description of Artificial Sequence: Synthetic oligonucleotide"
ugcggacacaauggacaagaggu

SEQ ID NO: 1994 - RNA, 23 nt, Artificial Sequence
  source: /note="Description of Artificial Sequence: Synthetic oligonucleotide"
ugacaacauuauugagcacucgu

SEQ ID NO: 1995 - RNA, 23 nt, Artificial Sequence
  source: /note="Description of Artificial Sequence: Synthetic oligonucleotide"
ucuaaacuccaaaugcaaacugg

SEQ ID NO: 1996 - RNA, 23 nt, Artificial Sequence
  source: /note="Description of Artificial Sequence: Synthetic oligonucleotide"
ugauccaaugggaaccaagcuga

SEQ ID NO: 1997 - RNA, 23 nt, Artificial Sequence
  source: /note="Description of Artificial Sequence: Synthetic oligonucleotide"
ucgacuaaagcaggauuucaggu

SEQ ID NO: 1998 - RNA, 23 nt, Artificial Sequence
  source: /note="Description of Artificial Sequence: Synthetic oligonucleotide"
ugugauuaugaauagcauucuua

SEQ ID NO: 1999 - RNA, 23 nt, Artificial Sequence
  source: /note="Description of Artificial Sequence: Synthetic oligonucleotide"
uauccaucaaagcuuugauaacu

SEQ ID NO: 2000 - RNA, 23 nt, Artificial Sequence
  source: /note="Description of Artificial Sequence: Synthetic oligonucleotide"
ucacgccaagaaucagcagagug

SEQ ID NO: 2001 - RNA, 23 nt, Artificial Sequence
  source: /note="Description of Artificial Sequence: Synthetic oligonucleotide"
uacaacauuguggucuuggugcu

SEQ ID NO: 2002 - RNA, 23 nt, Artificial Sequence
  source: /note="Description of Artificial Sequence: Synthetic oligonucleotide"
ucucgauucagagucauccucca

SEQ ID NO: 2003 - RNA, 23 nt, Artificial Sequence
  source: /note="Description of Artificial Sequence: Synthetic oligonucleotide"
ucgaagcagauaaaaggcggaca

SEQ ID NO: 2004 - RNA, 23 nt, Artificial Sequence
  source: /note="Description of Artificial Sequence: Synthetic oligonucleotide"
ucuccaugaucgauguaguucaa

SEQ ID NO: 2005 - RNA, 23 nt, Artificial Sequence
  source: /note="Description of Artificial Sequence: Synthetic oligonucleotide"
ucggagaaaugagauggaggcug

SEQ ID NO: 2006 - RNA, 23 nt, Artificial Sequence
  source: /note="Description of Artificial Sequence: Synthetic oligonucleotide"
uccuaaacuccaaaugcaaacug

SEQ ID NO: 2007 - RNA, 23 nt, Artificial Sequence
  source: /note="Description of Artificial Sequence: Synthetic oligonucleotide"
ucggccaaaaucaaagcaucuug

SEQ ID NO: 2008 - RNA, 23 nt, Artificial Sequence
  source: /note="Description of Artificial Sequence: Synthetic oligonucleotide"
ucucgacuaaagcaggauuucag

SEQ ID NO: 2009 - RNA, 23 nt, Artificial Sequence
  source: /note="Description of Artificial Sequence: Synthetic oligonucleotide"
ucgaaugugauuaugaauagcau

SEQ ID NO: 2010 - RNA, 23 nt, Artificial Sequence
  source: /note="Description of Artificial Sequence: Synthetic oligonucleotide"
uagauuagaauccaucaaagcuu

SEQ ID NO: 2011 - RNA, 23 nt, Artificial Sequence
  source: /note="Description of Artificial Sequence: Synthetic oligonucleotide"
ucauaaaccuggacaagcugcuc

SEQ ID NO: 2012 - RNA, 23 nt, Artificial Sequence
  source: /note="Description of Artificial Sequence: Synthetic oligonucleotide"
ucacaacauuguggucuuggugc

SEQ ID NO: 2013 - RNA, 23 nt, Artificial Sequence
  source: /note="Description of Artificial Sequence: Synthetic oligonucleotide"
uucucgauucagagucauccucc

SEQ ID NO: 2014 - RNA, 23 nt, Artificial Sequence
  source: /note="Description of Artificial Sequence: Synthetic oligonucleotide"
uuaccgucuaacacaauuucaga

SEQ ID NO: 2015 - RNA, 23 nt, Artificial Sequence
  source: /note="Description of Artificial Sequence: Synthetic oligonucleotide"
uacgaagcagauaaaaggcggac

SEQ ID NO: 2016 - RNA, 23 nt, Artificial Sequence
  source: /note="Description of Artificial Sequence: Synthetic oligonucleotide"
uaggaaugcaauccgccaaagaa

SEQ ID NO: 2017 - RNA, 23 nt, Artificial Sequence
  source: /note="Description of Artificial Sequence: Synthetic oligonucleotide"
uacggagaaaugagauggaggcu

SEQ ID NO: 2018 - RNA, 23 nt, Artificial Sequence
  source: /note="Description of Artificial Sequence: Synthetic oligonucleotide"
ucgguacagcucuuccuagacuc

SEQ ID NO: 2019 - RNA, 23 nt, Artificial Sequence
  source: /note="Description of Artificial Sequence: Synthetic oligonucleotide"
ucugcaagcaaguuuccggccaa

SEQ ID NO: 2020 - RNA, 23 nt, Artificial Sequence
  source: /note="Description of Artificial Sequence: Synthetic oligonucleotide"
uaucauugguucucgacuaaagc

SEQ ID NO: 2021 - RNA, 23 nt, Artificial Sequence
  source: /note="Description of Artificial Sequence: Synthetic oligonucleotide"
ucaaacgaaugugauuaugaaua

SEQ ID NO: 2022 - RNA, 23 nt, Artificial Sequence
  source: /note="Description of Artificial Sequence: Synthetic oligonucleotide"
uaaccuuggaagauuagaaucca

SEQ ID NO: 2023 - RNA, 23 nt, Artificial Sequence
  source: /note="Description of Artificial Sequence: Synthetic oligonucleotide"
ucuauaaguuccacaauacuccc

SEQ ID NO: 2024 - RNA, 23 nt, Artificial Sequence
  source: /note="Description of Artificial Sequence: Synthetic oligonucleotide"
uaucucgauucagagucauccuc

SEQ ID NO: 2025 - RNA, 23 nt, Artificial Sequence
  source: /note="Description of Artificial Sequence: Synthetic oligonucleotide"
uguaccgucuaacacaauuucag

SEQ ID NO: 2026 - RNA, 23 nt, Artificial Sequence
  source: /note="Description of Artificial Sequence: Synthetic oligonucleotide"
uaaggaaugcaauccgccaaaga

SEQ ID NO: 2027 - RNA, 23 nt, Artificial Sequence
  source: /note="Description of Artificial Sequence: Synthetic oligonucleotide"
ugacggagaaaugagauggaggc

SEQ ID NO: 2028 - RNA, 23 nt, Artificial Sequence
  source: /note="Description of Artificial Sequence: Synthetic oligonucleotide"
uacgguacagcucuuccuagacu

SEQ ID NO: 2029 - RNA, 23 nt, Artificial Sequence
  source: /note="Description of Artificial Sequence: Synthetic oligonucleotide"
uucggaugggacuuagagaaggg

SEQ ID NO: 2030 - RNA, 23 nt, Artificial Sequence
  source: /note="Description of Artificial Sequence: Synthetic oligonucleotide"
ucaucauugguucucgacuaaag

SEQ ID NO: 2031 - RNA, 21 nt, Artificial Sequence
  source: /note="Description of Artificial Sequence: Synthetic oligonucleotide"
ucauaaucacauucguuugua

SEQ ID NO: 2032 - RNA, 21 nt, Artificial Sequence
  source: /note="Description of Artificial Sequence: Synthetic oligonucleotide"
uucaguuacggguuaauuaca

SEQ ID NO: 2033 - RNA, 21 nt, Artificial Sequence
  source: /note="Description of Artificial Sequence: Synthetic oligonucleotide"
acugucucgacagauagcuga

SEQ ID NO: 2034 - RNA, 21 nt, Artificial Sequence
  source: /note="Description of Artificial Sequence: Synthetic oligonucleotide"
uuacggaguauguucgucaca

SEQ ID NO: 2035 - RNA, 21 nt, Artificial Sequence
  source: /note="Description of Artificial Sequence: Synthetic oligonucleotide"
gcaacauacuuucuauugcca

SEQ ID NO: 2036 - RNA, 21 nt, Artificial Sequence
  source: /note="Description of Artificial Sequence: Synthetic oligonucleotide"
acuccgagcacuuaacgugga

SEQ ID NO: 2037 - RNA, 21 nt, Artificial Sequence
  source: /note="Description of Artificial Sequence: Synthetic oligonucleotide"
gcaauucagucucguugugaa

SEQ ID NO: 2038 - RNA, 21 nt, Artificial Sequence
  source: /note="Description of Artificial Sequence: Synthetic oligonucleotide"
ugccuucaugaugaacucgga

SEQ ID NO: 2039 - RNA, 21 nt, Artificial Sequence
  source: /note="Description of Artificial Sequence: Synthetic oligonucleotide"
caacagcuacacacgugugca

SEQ ID NO: 2040 - RNA, 21 nt, Artificial Sequence
  source: /note="Description of Artificial Sequence: Synthetic oligonucleotide"
gacgcugacagaacugcgaaa

SEQ ID NO: 2041 - RNA, 21 nt, Artificial Sequence
  source: /note="Description of Artificial Sequence: Synthetic oligonucleotide"
cugacuuguuuacgaaaugua

SEQ ID NO: 2042 - RNA, 21 nt, Artificial Sequence
  source: /note="Description of Artificial Sequence: Synthetic oligonucleotide"
aucacauucguuuguuugaaa

SEQ ID NO: 2043 - RNA, 21 nt, Artificial Sequence
  source: /note="Description of Artificial Sequence: Synthetic oligonucleotide"
caguuacggguuaauuacuga

SEQ ID NO: 2044 - RNA, 21 nt, Artificial Sequence
  source: /note="Description of Artificial Sequence: Synthetic oligonucleotide"
aagcccuuggaguguuaaaua

SEQ ID NO: 2045 - RNA, 21 nt, Artificial Sequence
  source: /note="Description of Artificial Sequence: Synthetic oligonucleotide"
ucugauuucccagucaacuga

SEQ ID NO: 2046 - RNA, 21 nt, Artificial Sequence
  source: /note="Description of Artificial Sequence: Synthetic oligonucleotide"
aucuucaagucuggaauguua

SEQ ID NO: 2047 - RNA, 21 nt, Artificial Sequence
  source: /note="Description of Artificial Sequence: Synthetic oligonucleotide"
auccaggcaauucagucucga

SEQ ID NO: 2048 - RNA, 21 nt, Artificial Sequence
  source: /note="Description of Artificial Sequence: Synthetic oligonucleotide"
auggucgacauccuugcuuga

SEQ ID NO: 2049 - RNA, 21 nt, Artificial Sequence
  source: /note="Description of Artificial Sequence: Synthetic oligonucleotide"
cuucaugaugaacucggagua

SEQ ID NO: 2050 - RNA, 21 nt, Artificial Sequence
  source: /note="Description of Artificial Sequence: Synthetic oligonucleotide"
gaccagucguacucaguuuga

SEQ ID NO: 2051 - RNA, 21 nt, Artificial Sequence
  source: /note="Description of Artificial Sequence: Synthetic oligonucleotide"
acgcugacagaacugcgaaga

SEQ ID NO: 2052 - RNA, 21 nt, Artificial Sequence
  source: /note="Description of Artificial Sequence: Synthetic oligonucleotide"
ugacuuguuuacgaaauguca

SEQ ID NO: 2053 - RNA, 21 nt, Artificial Sequence
  source: /note="Description of Artificial Sequence: Synthetic oligonucleotide"
uguuugaaccucuuguuauaa

SEQ ID NO: 2054 - RNA, 21 nt, Artificial Sequence
  source: /note="Description of Artificial Sequence: Synthetic oligonucleotide"
ucagaucagguguuuauugga

SEQ ID NO: 2055 - RNA, 21 nt, Artificial Sequence
  source: /note="Description of Artificial Sequence: Synthetic oligonucleotide"
gcccuuggaguguuaaauaca

SEQ ID NO: 2056 - RNA, 21 nt, Artificial Sequence
  source: /note="Description of Artificial Sequence: Synthetic oligonucleotide"
aagauauuguucuuucucgua

SEQ ID NO: 2057 - RNA, 21 nt, Artificial Sequence
  source: /note="Description of Artificial Sequence: Synthetic oligonucleotide"
ucaagucuggaauguuccgga

SEQ ID NO: 2058 - RNA, 21 nt, Artificial Sequence
  source: /note="Description of Artificial Sequence: Synthetic oligonucleotide"
uccaggcaauucagucucgua

SEQ ID NO: 2059 - RNA, 21 nt, Artificial Sequence
  source: /note="Description of Artificial Sequence: Synthetic oligonucleotide"
gucgacauccuugcuugucga

SEQ ID NO: 2060 - RNA, 21 nt, Artificial Sequence
  source: /note="Description of Artificial Sequence: Synthetic oligonucleotide"
cugcuagcuccaugcuuaaga

SEQ ID NO: 2061 - RNA, 21 nt, Artificial Sequence
  source: /note="Description of Artificial Sequence: Synthetic oligonucleotide"
accagucguacucaguuugaa

SEQ ID NO: 2062 - RNA, 21 nt, Artificial Sequence
  source: /note="Description of Artificial Sequence: Synthetic oligonucleotide"
gaaaggagaaagucaguccga

SEQ ID NO: 2063 - RNA, 21 nt, Artificial Sequence
  source: /note="Description of Artificial Sequence: Synthetic oligonucleotide"
uaacguaacucuuucuaugca

SEQ ID NO: 2064 - RNA, 21 nt, Artificial Sequence
  source: /note="Description of Artificial Sequence: Synthetic oligonucleotide"
guuugaaccucuuguuauaaa

SEQ ID NO: 2065 - RNA, 21 nt, Artificial Sequence
  source: /note="Description of Artificial Sequence: Synthetic oligonucleotide"
uuggcuuuguauugaaacaga

SEQ ID NO: 2066 - RNA, 21 nt, Artificial Sequence
  source: /note="Description of Artificial Sequence: Synthetic oligonucleotide"
uagacaugcuuuuacggagua

SEQ ID NO: 2067 - RNA, 21 nt, Artificial Sequence
  source: /note="Description of Artificial Sequence: Synthetic oligonucleotide"
gauauuguucuuucucguaua

SEQ ID NO: 2068 - RNA, 21 nt, Artificial Sequence
  source: /note="Description of Artificial Sequence: Synthetic oligonucleotide"
caagucuggaauguuccggaa

SEQ ID NO: 2069 - RNA, 21 nt, Artificial Sequence
  source: /note="Description of Artificial Sequence: Synthetic oligonucleotide"
ccaggcaauucagucucguua

SEQ ID NO: 2070 - RNA, 21 nt, Artificial Sequence
  source: /note="Description of Artificial Sequence: Synthetic oligonucleotide"
caugcaagacucacuuaguca

SEQ ID NO: 2071 - RNA, 21 nt, Artificial Sequence
  source: /note="Description of Artificial Sequence: Synthetic oligonucleotide"
ugcuagcuccaugcuuaagca

SEQ ID NO: 2072 - RNA, 21 nt, Artificial Sequence
  source: /note="Description of Artificial Sequence: Synthetic oligonucleotide"
ccagucguacucaguuugaaa

SEQ ID NO: 2073 - RNA, 21 nt, Artificial Sequence
  source: /note="Description of Artificial Sequence: Synthetic oligonucleotide"
agaacuucagacccuaaucca

SEQ ID NO: 2074 - RNA, 21 nt, Artificial Sequence
  source: /note="Description of Artificial Sequence: Synthetic oligonucleotide"
ucuaugcccguguaaaguaua

SEQ ID NO: 2075 - RNA, 21 nt, Artificial Sequence
  source: /note="Description of Artificial Sequence: Synthetic oligonucleotide"
uuugaaccucuuguuauaaaa

SEQ ID NO: 2076 - RNA, 21 nt, Artificial Sequence
  source: /note="Description of Artificial Sequence: Synthetic oligonucleotide"
uuaugaacgcuaucauucaaa

SEQ ID NO: 2077 - RNA, 21 nt, Artificial Sequence
  source: /note="Description of Artificial Sequence: Synthetic oligonucleotide"
acaugcuuuuacggaguauga

SEQ ID NO: 2078 - RNA, 21 nt, Artificial Sequence
  source: /note="Description of Artificial Sequence: Synthetic oligonucleotide"
uuguucuuucucguauucaga

SEQ ID NO: 2079 - RNA, 21 nt, Artificial Sequence
  source: /note="Description of Artificial Sequence: Synthetic oligonucleotide"
agcacaaaguuacuuagucca

SEQ ID NO: 2080 - RNA, 21 nt, Artificial Sequence
  source: /note="Description of Artificial Sequence: Synthetic oligonucleotide"
caggcaauucagucucguuga

SEQ ID NO: 2081 - RNA, 21 nt, Artificial Sequence
  source: /note="Description of Artificial Sequence: Synthetic oligonucleotide"
augcaagacucacuuagucca

SEQ ID NO: 2082 - RNA, 21 nt, Artificial Sequence
  source: /note="Description of Artificial Sequence: Synthetic oligonucleotide"
acuggagcaaguugaaugaua

SEQ ID NO: 2083 - RNA, 21 nt, Artificial Sequence
  source: /note="Description of Artificial Sequence: Synthetic oligonucleotide"
cagucguacucaguuugaaga

SEQ ID NO: 2084 - RNA, 21 nt, Artificial Sequence
  source: /note="Description of Artificial Sequence: Synthetic oligonucleotide"
ucaugaacaaagucaucggaa

SEQ ID NO: 2085 - RNA, 21 nt, Artificial Sequence
  source: /note="Description of Artificial Sequence: Synthetic oligonucleotide"
cuaugcccguguaaaguauga

SEQ ID NO: 2086 - RNA, 21 nt, Artificial Sequence
  source: /note="Description of Artificial Sequence: Synthetic oligonucleotide"
aagcuuuaaaacaguacacga

SEQ ID NO: 2087 - RNA, 21 nt, Artificial Sequence
  source: /note="Description of Artificial Sequence: Synthetic oligonucleotide"
aacgcuaucauucaaaacaga

SEQ ID NO: 2088 - RNA, 21 nt, Artificial Sequence
  source: /note="Description of Artificial Sequence: Synthetic oligonucleotide"
cuuuuacggaguauguucgua

SEQ ID NO: 2089 - RNA, 21 nt, Artificial Sequence
  source: /note="Description of Artificial Sequence: Synthetic oligonucleotide"
uguucuuucucguauucagga

SEQ ID NO: 2090 - RNA, 21 nt, Artificial Sequence
  source: /note="Description of Artificial Sequence: Synthetic oligonucleotide"
agaggaggauucugacuugga

SEQ ID NO: 2091 - RNA, 21 nt, Artificial Sequence
  source: /note="Description of Artificial Sequence: Synthetic oligonucleotide"
aggcaauucagucucguugua

SEQ ID NO: 2092 - RNA, 21 nt, Artificial Sequence
  source: /note="Description of Artificial Sequence: Synthetic oligonucleotide"
cacuggaaacagugaguccga

SEQ ID NO: 2093 - RNA, 21 nt, Artificial Sequence
  source: /note="Description of Artificial Sequence: Synthetic oligonucleotide"
ugucaacagcuacacacguga

SEQ ID NO: 2094 - RNA, 21 nt, Artificial Sequence
  source: /note="Description of Artificial Sequence: Synthetic oligonucleotide"
aagcugagcauuaucagagga

SEQ ID NO: 2095 - RNA, 21 nt, Artificial Sequence
  source: /note="Description of Artificial Sequence: Synthetic oligonucleotide"
cggcugcugacuuguuuacga

SEQ ID NO: 2096 - RNA, 21 nt, Artificial Sequence
  source: /note="Description of Artificial Sequence: Synthetic oligonucleotide"
ccgcugacauuuccguuguaa

SEQ ID NO: 2097 - RNA, 21 nt, Artificial Sequence
  source: /note="Description of Artificial Sequence: Synthetic oligonucleotide"
agcugguucaguuacggguua

SEQ ID NO: 2098 - RNA, 21 nt, Artificial Sequence
  source: /note="Description of Artificial Sequence: Synthetic oligonucleotide"
guggaagcgacugucucgaca

SEQ ID NO: 2099 - RNA, 21 nt, Artificial Sequence
  source: /note="Description of Artificial Sequence: Synthetic oligonucleotide"
uuuuacggaguauguucguca

SEQ ID NO: 2100 - RNA, 21 nt, Artificial Sequence
  source: /note="Description of Artificial Sequence: Synthetic oligonucleotide"
auuuucaagguuucuauuaca

SEQ ID NO: 2101 - RNA, 21 nt, Artificial Sequence
  source: /note="Description of Artificial Sequence: Synthetic oligonucleotide"
caauagagaaauaguacgaaa

SEQ ID NO: 2102 - RNA, 21 nt, Artificial Sequence
  source: /note="Description of Artificial Sequence: Synthetic oligonucleotide"
ggcaauucagucucguuguga

SEQ ID NO: 2103 - RNA, 21 nt, Artificial Sequence
  source: /note="Description of Artificial Sequence: Synthetic oligonucleotide"
agcuggugaaucggauuccua

SEQ ID NO: 2104 - RNA, 21 nt, Artificial Sequence
  source: /note="Description of Artificial Sequence: Synthetic oligonucleotide"
gucaacagcuacacacgugua

SEQ ID NO: 2105 - RNA, 21 nt, Artificial Sequence
  source: /note="Description of Artificial Sequence: Synthetic oligonucleotide"
uugagcugauguaugugacga

SEQ ID NO: 2106 - RNA, 21 nt, Artificial Sequence
  source: /note="Description of Artificial Sequence: Synthetic oligonucleotide"
ggcugcugacuuguuuacgaa

SEQ ID NO: 2107 - RNA, 21 nt, Artificial Sequence
  source: /note="Description of Artificial Sequence: Synthetic oligonucleotide"
guucaguuacggguuaauuaa

SEQ ID NO: 2108 - RNA, 21 nt, Artificial Sequence
  source: /note="Description of Artificial Sequence: Synthetic oligonucleotide"
gacugucucgacagauagcua

SEQ ID NO: 2109 - RNA, 21 nt, Artificial Sequence
  source: /note="Description of Artificial Sequence: Synthetic oligonucleotide"
uuuacggaguauguucgucaa

SEQ ID NO: 2110 - RNA, 21 nt, Artificial Sequence
  source: /note="Description of Artificial Sequence: Synthetic oligonucleotide"
aagguuucuauuacaacugga

SEQ ID NO: 2111 - RNA, 21 nt, Artificial Sequence
  source: /note="Description of Artificial Sequence: Synthetic oligonucleotide"
gacuccgagcacuuaacguga

SEQ ID NO: 2112 - RNA, 21 nt, Artificial Sequence
  source: /note="Description of Artificial Sequence: Synthetic oligonucleotide"
gcuggugaaucggauuccuga

SEQ ID NO: 2113 - RNA, 21 nt, Artificial Sequence
  source: /note="Description of Artificial Sequence: Synthetic oligonucleotide"
ucaacagcuacacacguguga

SEQ ID NO: 2114 - RNA, 21 nt, Artificial Sequence
  source: /note="Description of Artificial Sequence: Synthetic oligonucleotide"
gagcugauguaugugacgcua

SEQ ID NO: 2115 - RNA, 21 nt, Artificial Sequence
  source: /note="Description of Artificial Sequence: Synthetic oligonucleotide"
cugcugacuuguuuacgaaaa

SEQ ID NO: 2116 - RNA, 21 nt, Artificial Sequence
  source: /note="Description of Artificial Sequence: Synthetic oligonucleotide"
agcuaccaagaaagaccguga

SEQ ID NO: 2117 - RNA, 21 nt, Artificial Sequence
  source: /note="Description of Artificial Sequence: Synthetic oligonucleotide"
auucuaaucuuccaagguuaa

SEQ ID NO: 2118 - RNA, 21 nt, Artificial Sequence
  source: /note="Description of Artificial Sequence: Synthetic oligonucleotide"
agguuuaugaacugacguuaa

SEQ ID NO: 2119 - RNA, 21 nt, Artificial Sequence
  source: /note="Description of Artificial Sequence: Synthetic oligonucleotide"
aguauuguggaacuuauagca

SEQ ID NO: 2120 - RNA, 21 nt, Artificial Sequence
  source: /note="Description of Artificial Sequence: Synthetic oligonucleotide"
gacucugaaucgagaucggaa

SEQ ID NO: 2121 - RNA, 21 nt, Artificial Sequence
  source: /note="Description of Artificial Sequence: Synthetic oligonucleotide"
acagcaguguugauaaauuua

SEQ ID NO: 2122 - RNA, 21 nt, Artificial Sequence
  source: /note="Description of Artificial Sequence: Synthetic oligonucleotide"
cgccuuuuaucugcuucguua

SEQ ID NO: 2123 - RNA, 21 nt, Artificial Sequence
  source: /note="Description of Artificial Sequence: Synthetic oligonucleotide"
cugaggaacaguuccuauuga

SEQ ID NO: 2124 - RNA, 21 nt, Artificial Sequence
  source: /note="Description of Artificial Sequence: Synthetic oligonucleotide"
uaggaagagcuguaccguuga

SEQ ID NO: 2125 - RNA, 21 nt, Artificial Sequence
  source: /note="Description of Artificial Sequence: Synthetic oligonucleotide"
uucucuaagucccauccgaca

SEQ ID NO: 2126 - RNA, 21 nt, Artificial Sequence
  source: /note="Description of Artificial Sequence: Synthetic oligonucleotide"
cuaccaagaaagaccguguga

SEQ ID NO: 2127 - RNA, 21 nt, Artificial Sequence
  source: /note="Description of Artificial Sequence: Synthetic oligonucleotide"
uuccaagguuacagcucgaga

SEQ ID NO: 2128 - RNA, 21 nt, Artificial Sequence
  source: /note="Description of Artificial Sequence: Synthetic oligonucleotide"
gguuuaugaacugacguuaca

SEQ ID NO: 2129 - RNA, 21 nt, Artificial Sequence
  source: /note="Description of Artificial Sequence: Synthetic oligonucleotide"
guauuguggaacuuauagcua

SEQ ID NO: 2130 - RNA, 21 nt, Artificial Sequence
  source: /note="Description of Artificial Sequence: Synthetic oligonucleotide"
acucugaaucgagaucggaua

SEQ ID NO: 2131 - RNA, 21 nt, Artificial Sequence
  source: /note="Description of Artificial Sequence: Synthetic oligonucleotide"
ugauaaauuuguguugagaga

SEQ ID NO: 2132 - RNA, 21 nt, Artificial Sequence
  source: /note="Description of Artificial Sequence: Synthetic oligonucleotide"
ucuauaaaguuccucuugaca

SEQ ID NO: 2133 - RNA, 21 nt, Artificial Sequence
  source: /note="Description of Artificial Sequence: Synthetic oligonucleotide"
ugaggaacaguuccuauugga

SEQ ID NO: 2134 - RNA, 21 nt, Artificial Sequence
  source: /note="Description of Artificial Sequence: Synthetic oligonucleotide"
ucuccgucagcacaauaacca

SEQ ID NO: 2135 - RNA, 21 nt, Artificial Sequence
  source: /note="Description of Artificial Sequence: Synthetic oligonucleotide"
aggaagagcuguaccguugga

SEQ ID NO: 2136 - RNA, 21 nt, Artificial Sequence
  source: /note="Description of Artificial Sequence: Synthetic oligonucleotide"
gagaacaagcaucuguaccga

SEQ ID NO: 2137 - RNA, 21 nt, Artificial Sequence
  source: /note="Description of Artificial Sequence: Synthetic oligonucleotide"
gagugucacaaagaaccguga

SEQ ID NO: 2138 - RNA, 21 nt, Artificial Sequence
  source: /note="Description of Artificial Sequence: Synthetic oligonucleotide"
aaucauugucugacaauauga

SEQ ID NO: 2139 - RNA, 21 nt, Artificial Sequence
  source: /note="Description of Artificial Sequence: Synthetic oligonucleotide"
uccaagguuacagcucgagca

SEQ ID NO: 2140 - RNA, 21 nt, Artificial Sequence
  source: /note="Description of Artificial Sequence: Synthetic oligonucleotide"
uuuaugaacugacguuacaua

SEQ ID NO: 2141 - RNA, 21 nt, Artificial Sequence
  source: /note="Description of Artificial Sequence: Synthetic oligonucleotide"
uauuguggaacuuauagcuga

SEQ ID NO: 2142 - RNA, 21 nt, Artificial Sequence
  source: /note="Description of Artificial Sequence: Synthetic oligonucleotide"
cucugaaucgagaucggauga

SEQ ID NO: 2143 - RNA, 21 nt, Artificial Sequence
  source: /note="Description of Artificial Sequence: Synthetic oligonucleotide"
agaugaagcuacugaaccgga

SEQ ID NO: 2144 - RNA, 21 nt, Artificial Sequence
  source: /note="Description of Artificial Sequence: Synthetic oligonucleotide"
caucuugaacuacaucgauca

SEQ ID NO: 2145 - RNA, 21 nt, Artificial Sequence
  source: /note="Description of Artificial Sequence: Synthetic oligonucleotide"
uccgucagcacaauaaccaga

SEQ ID NO: 2146 - RNA, 21 nt, Artificial Sequence
  source: /note="Description of Artificial Sequence: Synthetic oligonucleotide"
ggaagagcuguaccguuggga

SEQ ID NO: 2147 - RNA, 21 nt, Artificial Sequence
  source: /note="Description of Artificial Sequence: Synthetic oligonucleotide"
ugucacaaagaaccgugcaga

SEQ ID NO: 2148 - RNA, 21 nt, Artificial Sequence
  source: /note="Description of Artificial Sequence: Synthetic oligonucleotide"
cauugucugacaauaugugaa

SEQ ID NO: 2149 - RNA, 21 nt, Artificial Sequence
  source: /note="Description of Artificial Sequence: Synthetic oligonucleotide"
cuguucccaaaauuauggcua

SEQ ID NO: 2150 - RNA, 21 nt, Artificial Sequence
  source: /note="Description of Artificial Sequence: Synthetic oligonucleotide"
cagcaccaagaccacaaugua

SEQ ID NO: 2151 - RNA, 21 nt, Artificial Sequence
  source: /note="Description of Artificial Sequence: Synthetic oligonucleotide"
auuguggaacuuauagcugga

SEQ ID NO: 2152 - RNA, 21 nt, Artificial Sequence
  source: /note="Description of Artificial Sequence: Synthetic oligonucleotide"
uucugaaauuguguuagacga

SEQ ID NO: 2153 - RNA, 21 nt, Artificial Sequence
  source: /note="Description of Artificial Sequence: Synthetic oligonucleotide"
ccucuuguccauuguguccga

SEQ ID NO: 2154 - RNA, 21 nt, Artificial Sequence
  source: /note="Description of Artificial Sequence: Synthetic oligonucleotide"
cuugaacuacaucgaucauga

SEQ ID NO: 2155 - RNA, 21 nt, Artificial Sequence
  source: /note="Description of Artificial Sequence: Synthetic oligonucleotide"
aagaacgagugcucaauaaua

SEQ ID NO: 2156 - RNA, 21 nt, Artificial Sequence
  source: /note="Description of Artificial Sequence: Synthetic oligonucleotide"
aaccuuucaagaguuauugca

SEQ ID NO: 2157 - RNA, 21 nt, Artificial Sequence
  source: /note="Description of Artificial Sequence: Synthetic oligonucleotide"
gucagcuugguucccauugga

SEQ ID NO: 2158 - RNA, 21 nt, Artificial Sequence
  source: /note="Description of Artificial Sequence: Synthetic oligonucleotide"
ccugaaauccugcuuuaguca

SEQ ID NO: 2159 - RNA, 21 nt, Artificial Sequence
  source: /note="Description of Artificial Sequence: Synthetic oligonucleotide"
uaagaaugcuauucauaauca

SEQ ID NO: 2160 - RNA, 21 nt, Artificial Sequence
  source: /note="Description of Artificial Sequence: Synthetic oligonucleotide"
aaugccucaacaaaguuauca

SEQ ID NO: 2161 - RNA, 21 nt, Artificial Sequence
  source: /note="Description of Artificial Sequence: Synthetic oligonucleotide"
aggccuucauagcgaaccuga

SEQ ID NO: 2162 - RNA, 21 nt, Artificial Sequence
  source: /note="Description of Artificial Sequence: Synthetic oligonucleotide"
gcaccaagaccacaauguuga

SEQ ID NO: 2163 - RNA, 21 nt, Artificial Sequence
  source: /note="Description of Artificial Sequence: Synthetic oligonucleotide"
uggaggaugacucugaaucga

SEQ ID NO: 2164 - RNA, 21 nt, Artificial Sequence
  source: /note="Description of Artificial Sequence: Synthetic oligonucleotide"
ucugaaauuguguuagacgga

SEQ ID NO: 2165 - RNA, 21 nt, Artificial Sequence
  source: /note="Description of Artificial Sequence: Synthetic oligonucleotide"
cucuuguccauuguguccgca

SEQ ID NO: 2166 - RNA, 21 nt, Artificial Sequence
  source: /note="Description of Artificial Sequence: Synthetic oligonucleotide"
gagugcucaauaauguuguca

SEQ ID NO: 2167 - RNA, 21 nt, Artificial Sequence
  source: /note="Description of Artificial Sequence: Synthetic oligonucleotide"
aguuugcauuuggaguuuaga

SEQ ID NO: 2168 - RNA, 21 nt, Artificial Sequence
  source: /note="Description of Artificial Sequence: Synthetic oligonucleotide"
agcuugguucccauuggauca

SEQ ID NO: 2169 - RNA, 21 nt, Artificial Sequence
  source: /note="Description of Artificial Sequence: Synthetic oligonucleotide"
cugaaauccugcuuuagucga

SEQ ID NO: 2170 - RNA, 21 nt, Artificial Sequence
  source: /note="Description of Artificial Sequence: Synthetic oligonucleotide"
agaaugcuauucauaaucaca

SEQ ID NO: 2171 - RNA, 21 nt, Artificial Sequence
  source: /note="Description of Artificial Sequence: Synthetic oligonucleotide"
uuaucaaagcuuugauggaua

SEQ ID NO: 2172 - RNA, 21 nt, Artificial Sequence
  source: /note="Description of Artificial Sequence: Synthetic oligonucleotide"
cucugcugauucuuggcguga

SEQ ID NO: 2173 - RNA, 21 nt, Artificial Sequence
  source: /note="Description of Artificial Sequence: Synthetic oligonucleotide"
caccaagaccacaauguugua

SEQ ID NO: 2174 - RNA, 21 nt, Artificial Sequence
  source: /note="Description of Artificial Sequence: Synthetic oligonucleotide"
gaggaugacucugaaucgaga

SEQ ID NO: 2175 - RNA, 21 nt, Artificial Sequence
  source: /note="Description of Artificial Sequence: Synthetic oligonucleotide"
cugaaauuguguuagacggua

SEQ ID NO: 2176 - RNA, 21 nt, Artificial Sequence
  source: /note="Description of Artificial Sequence: Synthetic oligonucleotide"
uccgccuuuuaucugcuucga

SEQ ID NO: 2177 - RNA, 21 nt, Artificial Sequence
  source: /note="Description of Artificial Sequence: Synthetic oligonucleotide"
gaacuacaucgaucauggaga

SEQ ID NO: 2178 - RNA, 21 nt, Artificial Sequence
  source: /note="Description of Artificial Sequence: Synthetic oligonucleotide"
gccuccaucucauuucuccga

SEQ ID NO: 2179 - RNA, 21 nt, Artificial Sequence
  source: /note="Description of Artificial Sequence: Synthetic oligonucleotide"
guuugcauuuggaguuuagga

SEQ ID NO: 2180 - RNA, 21 nt, Artificial Sequence
  source: /note="Description of Artificial Sequence: Synthetic oligonucleotide"
agaugcuuugauuuuggccga

SEQ ID NO: 2181 - RNA, 21 nt, Artificial Sequence
  source: /note="Description of Artificial Sequence: Synthetic oligonucleotide"
gaaauccugcuuuagucgaga

SEQ ID NO: 2182 - RNA, 21 nt, Artificial Sequence
  source: /note="Description of Artificial Sequence: Synthetic oligonucleotide"
gcuauucauaaucacauucga

SEQ ID NO: 2183 - RNA, 21 nt, Artificial Sequence
  source: /note="Description of Artificial Sequence: Synthetic oligonucleotide"
gcuuugauggauucuaaucua

SEQ ID NO: 2184 - RNA, 21 nt, Artificial Sequence
  source: /note="Description of Artificial Sequence: Synthetic oligonucleotide"
gcagcuuguccagguuuauga

SEQ ID NO: 2185 - RNA, 21 nt, Artificial Sequence
  source: /note="Description of Artificial Sequence: Synthetic oligonucleotide"
accaagaccacaauguuguga

SEQ ID NO: 2186 - RNA, 21 nt, Artificial Sequence
  source: /note="Description of Artificial Sequence: Synthetic oligonucleotide"
aggaugacucugaaucgagaa

SEQ ID NO: 2187 - RNA, 21 nt, Artificial Sequence
  source: /note="Description of Artificial Sequence: Synthetic oligonucleotide"
ugaaauuguguuagacgguaa

SEQ ID NO: 2188 - RNA, 21 nt, Artificial Sequence
  source: /note="Description of Artificial Sequence: Synthetic oligonucleotide"
ccgccuuuuaucugcuucgua

SEQ ID NO: 2189 - RNA, 21 nt, Artificial Sequence
  source: /note="Description of Artificial Sequence: Synthetic oligonucleotide"
cuuuggcggauugcauuccua

SEQ ID NO: 2190 - RNA, 21 nt, Artificial Sequence
  source: /note="Description of Artificial Sequence: Synthetic oligonucleotide"
ccuccaucucauuucuccgua

SEQ ID NO: 2191 - RNA, 21 nt, Artificial Sequence
  source: /note="Description of Artificial Sequence: Synthetic oligonucleotide"
gucuaggaagagcuguaccga

SEQ ID NO: 2192 - RNA, 21 nt, Artificial Sequence
  source: /note="Description of Artificial Sequence: Synthetic oligonucleotide"
ggccggaaacuugcuugcaga

SEQ ID NO: 2193 - RNA, 21 nt, Artificial Sequence
  source: /note="Description of Artificial Sequence: Synthetic oligonucleotide"
uuuagucgagaaccaaugaua

SEQ ID NO: 2194 - RNA, 21 nt, Artificial Sequence
  source: /note="Description of Artificial Sequence: Synthetic oligonucleotide"
uucauaaucacauucguuuga

SEQ ID NO: 2195 - RNA, 21 nt, Artificial Sequence
  source: /note="Description of Artificial Sequence: Synthetic oligonucleotide"
gauucuaaucuuccaagguua

SEQ ID NO: 2196 - RNA, 21 nt, Artificial Sequence
  source: /note="Description of Artificial Sequence: Synthetic oligonucleotide"
cagguuuaugaacugacguua

SEQ ID NO: 2197 - RNA, 21 nt, Artificial Sequence
  source: /note="Description of Artificial Sequence: Synthetic oligonucleotide"
gaguauuguggaacuuauaga

SEQ ID NO: 2198 - RNA, 21 nt, Artificial Sequence
  source: /note="Description of Artificial Sequence: Synthetic oligonucleotide"
ggaugacucugaaucgagaua

SEQ ID NO: 2199 - RNA, 21 nt, Artificial Sequence
  source: /note="Description of Artificial Sequence: Synthetic oligonucleotide"
gaaauuguguuagacgguaca

SEQ ID NO: 2200 - RNA, 21 nt, Artificial Sequence
  source: /note="Description of Artificial Sequence: Synthetic oligonucleotide"
uuuggcggauugcauuccuua

SEQ ID NO: 2201 - RNA, 21 nt, Artificial Sequence
  source: /note="Description of Artificial Sequence: Synthetic oligonucleotide"
cuccaucucauuucuccguca

SEQ ID NO: 2202 - RNA, 21 nt, Artificial Sequence
  source: /note="Description of Artificial Sequence: Synthetic oligonucleotide"
ucuaggaagagcuguaccgua

SEQ ID NO: 2203 - RNA, 21 nt, Artificial Sequence
  source: /note="Description of Artificial Sequence: Synthetic oligonucleotide"
cuucucuaagucccauccgaa

SEQ ID NO: 2204 - RNA, 21 nt, Artificial Sequence
  source: /note="Description of Artificial Sequence: Synthetic oligonucleotide"
uuagucgagaaccaaugauga

SEQ ID NO: 2205 - RNA, 23 nt, Artificial Sequence
  source: /note="Description of Artificial Sequence: Synthetic oligonucleotide"
uacaaacgaaugugauuaugaau

SEQ ID NO: 2206 - RNA, 23 nt, Artificial Sequence
  source: /note="Description of Artificial Sequence: Synthetic oligonucleotide"
uguaauuaacccguaacugaacc

SEQ ID NO: 2207 - RNA, 23 nt, Artificial Sequence
  source: /note="Description of Artificial Sequence: Synthetic oligonucleotide"
ucagcuaucugucgagacagucg

SEQ ID NO: 2208 - RNA, 23 nt, Artificial Sequence
  source: /note="Description of Artificial Sequence: Synthetic oligonucleotide"
ugugacgaacauacuccguaaaa

SEQ ID NO: 2209 - RNA, 23 nt, Artificial Sequence
  source: /note="Description of Artificial Sequence: Synthetic oligonucleotide"
uggcaauagaaaguauguugcug

SEQ ID NO: 2210 - RNA, 23 nt, Artificial Sequence
  source: /note="Description of Artificial Sequence: Synthetic oligonucleotide"
uccacguuaagugcucggaguca

SEQ ID NO: 2211 - RNA, 23 nt, Artificial Sequence
  source: /note="Description of Artificial Sequence: Synthetic oligonucleotide"
uucacaacgagacugaauugccu

SEQ ID NO: 2212 - RNA, 23 nt, Artificial Sequence
  source: /note="Description of Artificial Sequence: Synthetic oligonucleotide"
uccgaguucaucaugaaggcauu

SEQ ID NO: 2213 - RNA, 23 nt, Artificial Sequence
  source: /note="Description of Artificial Sequence: Synthetic oligonucleotide"
ugcacacguguguagcuguugac

SEQ ID NO: 2214 - RNA, 23 nt, Artificial Sequence
  source: /note="Description of Artificial Sequence: Synthetic oligonucleotide"
uuucgcaguucugucagcgucac

SEQ ID NO: 2215 - RNA, 23 nt, Artificial Sequence
  source: /note="Description of Artificial Sequence: Synthetic oligonucleotide"
uacauuucguaaacaagucagca

SEQ ID NO: 2216 - RNA, 23 nt, Artificial Sequence
  source: /note="Description of Artificial Sequence: Synthetic oligonucleotide"
uuucaaacaaacgaaugugauua

SEQ ID NO: 2217 - RNA, 23 nt, Artificial Sequence
  source: /note="Description of Artificial Sequence: Synthetic oligonucleotide"
ucaguaauuaacccguaacugaa

SEQ ID NO: 2218 - RNA, 23 nt, Artificial Sequence
  source: /note="Description of Artificial Sequence: Synthetic oligonucleotide"
uauuuaacacuccaagggcuuca

SEQ ID NO: 2219 - RNA, 23 nt, Artificial Sequence
  source: /note="Description of Artificial Sequence: Synthetic oligonucleotide"
ucaguugacugggaaaucagaac

SEQ ID NO: 2220 - RNA, 23 nt, Artificial Sequence
  source: /note="Description of Artificial Sequence: Synthetic oligonucleotide"
uaacauuccagacuugaagaugu

SEQ ID NO: 2221 - RNA, 23 nt, Artificial Sequence
  source: /note="Description of Artificial Sequence: Synthetic oligonucleotide"
ucgagacugaauugccuggauga

SEQ ID NO: 2222 - RNA, 23 nt, Artificial Sequence
  source: /note="Description of Artificial Sequence: Synthetic oligonucleotide"
ucaagcaaggaugucgaccaugc

SEQ ID NO: 2223 - RNA, 23 nt, Artificial Sequence
  source: /note="Description of Artificial Sequence: Synthetic oligonucleotide"
uacuccgaguucaucaugaaggc

SEQ ID NO: 2224 - RNA, 23 nt, Artificial Sequence
  source: /note="Description of Artificial Sequence: Synthetic oligonucleotide"
ucaaacugaguacgacuggucca

SEQ ID NO: 2225 - RNA, 23 nt, Artificial Sequence
  source: /note="Description of Artificial Sequence: Synthetic oligonucleotide"
ucuucgcaguucugucagcguca

SEQ ID NO: 2226 - RNA, 23 nt, Artificial Sequence
  source: /note="Description of Artificial Sequence: Synthetic oligonucleotide"
ugacauuucguaaacaagucagc

SEQ ID NO: 2227 - RNA, 23 nt, Artificial Sequence
  source: /note="Description of Artificial Sequence: Synthetic oligonucleotide"
uuauaacaagagguucaaacaaa

SEQ ID NO: 2228 - RNA, 23 nt, Artificial Sequence
  source: /note="Description of Artificial Sequence: Synthetic oligonucleotide"
uccaauaaacaccugaucugaau

SEQ ID NO: 2229 - RNA, 23 nt, Artificial Sequence
  source: /note="Description of Artificial Sequence: Synthetic oligonucleotide"
uguauuuaacacuccaagggcuu

SEQ ID NO: 2230 - RNA, 23 nt, Artificial Sequence
  source: /note="Description of Artificial Sequence: Synthetic oligonucleotide"
uacgagaaagaacaauaucuuca

SEQ ID NO: 2231 - RNA, 23 nt, Artificial Sequence
  source: /note="Description of Artificial Sequence: Synthetic oligonucleotide"
uccggaacauuccagacuugaag

SEQ ID NO: 2232 - RNA, 23 nt, Artificial Sequence
  source: /note="Description of Artificial Sequence: Synthetic oligonucleotide"
uacgagacugaauugccuggaug

SEQ ID NO: 2233 - RNA, 23 nt, Artificial Sequence
  source: /note="Description of Artificial Sequence: Synthetic oligonucleotide"
ucgacaagcaaggaugucgacca

SEQ ID NO: 2234 - RNA, 23 nt, Artificial Sequence
  source: /note="Description of Artificial Sequence: Synthetic oligonucleotide"
ucuuaagcauggagcuagcaggc

SEQ ID NO: 2235 - RNA, 23 nt, Artificial Sequence
  source: /note="Description of Artificial Sequence: Synthetic oligonucleotide"
uucaaacugaguacgacuggucc

SEQ ID NO: 2236 - RNA, 23 nt, Artificial Sequence
  source: /note="Description of Artificial Sequence: Synthetic oligonucleotide"
ucggacugacuuucuccuuuccu

SEQ ID NO: 2237 - RNA, 23 nt, Artificial Sequence
  source: /note="Description of Artificial Sequence: Synthetic oligonucleotide"
ugcauagaaagaguuacguuaaa

SEQ ID NO: 2238 - RNA, 23 nt, Artificial Sequence
  source: /note="Description of Artificial Sequence: Synthetic oligonucleotide"
uuuauaacaagagguucaaacaa

SEQ ID NO: 2239 - RNA, 23 nt, Artificial Sequence
  source: /note="Description of Artificial Sequence: Synthetic oligonucleotide"
ucuguuucaauacaaagccaaua

SEQ ID NO: 2240 - RNA, 23 nt, Artificial Sequence
  source: /note="Description of Artificial Sequence: Synthetic oligonucleotide"
uacuccguaaaagcaugucuacc

SEQ ID NO: 2241 - RNA, 23 nt, Artificial Sequence
  source: /note="Description of Artificial Sequence: Synthetic oligonucleotide"
uauacgagaaagaacaauaucuu

SEQ ID NO: 2242 - RNA, 23 nt, Artificial Sequence
  source: /note="Description of Artificial Sequence: Synthetic oligonucleotide"
uuccggaacauuccagacuugaa

SEQ ID NO: 2243 - RNA, 23 nt, Artificial Sequence
  source: /note="Description of Artificial Sequence: Synthetic oligonucleotide"
uaacgagacugaauugccuggau

SEQ ID NO: 2244 - RNA, 23 nt, Artificial Sequence
  source: /note="Description of Artificial Sequence: Synthetic oligonucleotide"
ugacuaagugagucuugcauggu

SEQ ID NO: 2245 - RNA, 23 nt, Artificial Sequence
  source: /note="Description of Artificial Sequence: Synthetic oligonucleotide"
ugcuuaagcauggagcuagcagg

SEQ ID NO: 2246 - RNA, 23 nt, Artificial Sequence
  source: /note="Description of Artificial Sequence: Synthetic oligonucleotide"
uuucaaacugaguacgacugguc

SEQ ID NO: 2247 - RNA, 23 nt, Artificial Sequence
  source: /note="Description of Artificial Sequence: Synthetic oligonucleotide"
uggauuagggucugaaguucuac

SEQ ID NO: 2248 - RNA, 23 nt, Artificial Sequence
  source: /note="Description of Artificial Sequence: Synthetic oligonucleotide"
uauacuuuacacgggcauagaaa

SEQ ID NO: 2249 - RNA, 23 nt, Artificial Sequence
  source: /note="Description of Artificial Sequence: Synthetic oligonucleotide"
uuuuauaacaagagguucaaaca

SEQ ID NO: 2250 - RNA, 23 nt, Artificial Sequence
  source: /note="Description of Artificial Sequence: Synthetic oligonucleotide"
uuugaaugauagcguucauaaga

SEQ ID NO: 2251 - RNA, 23 nt, Artificial Sequence
  source: /note="Description of Artificial Sequence: Synthetic oligonucleotide"
ucauacuccguaaaagcaugucu

SEQ ID NO: 2252 - RNA, 23 nt, Artificial Sequence
  source: /note="Description of Artificial Sequence: Synthetic oligonucleotide"
ucugaauacgagaaagaacaaua

SEQ ID NO: 2253 - RNA, 23 nt, Artificial Sequence
  source: /note="Description of Artificial Sequence: Synthetic oligonucleotide"
uggacuaaguaacuuugugcugg

SEQ ID NO: 2254 - RNA, 23 nt, Artificial Sequence
  source: /note="Description of Artificial Sequence: Synthetic oligonucleotide"
ucaacgagacugaauugccugga

SEQ ID NO: 2255 - RNA, 23 nt, Artificial Sequence
  source: /note="Description of Artificial Sequence: Synthetic oligonucleotide"
uggacuaagugagucuugcaugg

SEQ ID NO: 2256 - RNA, 23 nt, Artificial Sequence
  source: /note="Description of Artificial Sequence: Synthetic oligonucleotide"
uaucauucaacuugcuccaguag

SEQ ID NO: 2257 - RNA, 23 nt, Artificial Sequence
  source: /note="Description of Artificial Sequence: Synthetic oligonucleotide"
ucuucaaacugaguacgacuggu

SEQ ID NO: 2258 - RNA, 23 nt, Artificial Sequence
  source: /note="Description of Artificial Sequence: Synthetic oligonucleotide"
uuccgaugacuuuguucaugaug

SEQ ID NO: 2259 - RNA, 23 nt, Artificial Sequence
  source: /note="Description of Artificial Sequence: Synthetic oligonucleotide"
ucauacuuuacacgggcauagaa

SEQ ID NO: 2260 - RNA, 23 nt, Artificial Sequence
  source: /note="Description of Artificial Sequence: Synthetic oligonucleotide"
ucguguacuguuuuaaagcuuuu

SEQ ID NO: 2261 - RNA, 23 nt, Artificial Sequence
  source: /note="Description of Artificial Sequence: Synthetic oligonucleotide"
ucuguuuugaaugauagcguuca

SEQ ID NO: 2262 - RNA, 23 nt, Artificial Sequence
  source: /note="Description of Artificial Sequence: Synthetic oligonucleotide"
uacgaacauacuccguaaaagca

SEQ ID NO: 2263 - RNA, 23 nt, Artificial Sequence
  source: /note="Description of Artificial Sequence: Synthetic oligonucleotide"
uccugaauacgagaaagaacaau

SEQ ID NO: 2264 - RNA, 23 nt, Artificial Sequence
  source: /note="Description of Artificial Sequence: Synthetic oligonucleotide"
uccaagucagaauccuccucuuc

SEQ ID NO: 2265 - RNA, 23 nt, Artificial Sequence
  source: /note="Description of Artificial Sequence: Synthetic oligonucleotide"
uacaacgagacugaauugccugg

SEQ ID NO: 2266 - RNA, 23 nt, Artificial Sequence
  source: /note="Description of Artificial Sequence: Synthetic oligonucleotide"
ucggacucacuguuuccagugac

SEQ ID NO: 2267 - RNA, 23 nt, Artificial Sequence
  source: /note="Description of Artificial Sequence: Synthetic oligonucleotide"
ucacguguguagcuguugacaag

SEQ ID NO: 2268 - RNA, 23 nt, Artificial Sequence
  source: /note="Description of Artificial Sequence: Synthetic oligonucleotide"
uccucugauaaugcucagcuucc

SEQ ID NO: 2269 - RNA, 23 nt, Artificial Sequence
  source: /note="Description of Artificial Sequence: Synthetic oligonucleotide"
ucguaaacaagucagcagccggu

SEQ ID NO: 2270 - RNA, 23 nt, Artificial Sequence
  source: /note="Description of Artificial Sequence: Synthetic oligonucleotide"
uuacaacggaaaugucagcgggu

SEQ ID NO: 2271 - RNA, 23 nt, Artificial Sequence
  source: /note="Description of Artificial Sequence: Synthetic oligonucleotide"
uaacccguaacugaaccagcugc

SEQ ID NO: 2272 - RNA, 23 nt, Artificial Sequence
  source: /note="Description of Artificial Sequence: Synthetic oligonucleotide"
ugucgagacagucgcuuccacuu

SEQ ID NO: 2273 - RNA, 23 nt, Artificial Sequence
  source: /note="Description of Artificial Sequence: Synthetic oligonucleotide"
ugacgaacauacuccguaaaagc

SEQ ID NO: 2274 - RNA, 23 nt, Artificial Sequence
  source: /note="Description of Artificial Sequence: Synthetic oligonucleotide"
uguaauagaaaccuugaaaaugu

SEQ ID NO: 2275 - RNA, 23 nt, Artificial Sequence
  source: /note="Description of Artificial Sequence: Synthetic oligonucleotide"
uuucguacuauuucucuauugca

SEQ ID NO: 2276 - RNA, 23 nt, Artificial Sequence
  source: /note="Description of Artificial Sequence: Synthetic oligonucleotide"
ucacaacgagacugaauugccug

SEQ ID NO: 2277 - RNA, 23 nt, Artificial Sequence
  source: /note="Description of Artificial Sequence: Synthetic oligonucleotide"
uaggaauccgauucaccagcucu

SEQ ID NO: 2278 - RNA, 23 nt, Artificial Sequence
  source: /note="Description of Artificial Sequence: Synthetic oligonucleotide"
uacacguguguagcuguugacaa

SEQ ID NO: 2279 - RNA, 23 nt, Artificial Sequence
  source: /note="Description of Artificial Sequence: Synthetic oligonucleotide"
ucgucacauacaucagcucaaac

SEQ ID NO: 2280 - RNA, 23 nt, Artificial Sequence
  source: /note="Description of Artificial Sequence: Synthetic oligonucleotide"
uucguaaacaagucagcagccgg

SEQ ID NO: 2281 - RNA, 23 nt, Artificial Sequence
  source: /note="Description of Artificial Sequence: Synthetic oligonucleotide"
uuaauuaacccguaacugaacca

SEQ ID NO: 2282 - RNA, 23 nt, Artificial Sequence
  source: /note="Description of Artificial Sequence: Synthetic oligonucleotide"
uagcuaucugucgagacagucgc

SEQ ID NO: 2283 - RNA, 23 nt, Artificial Sequence
  source: /note="Description of Artificial Sequence: Synthetic oligonucleotide"
uugacgaacauacuccguaaaag

SEQ ID NO: 2284 - RNA, 23 nt, Artificial Sequence
  source: /note="Description of Artificial Sequence: Synthetic oligonucleotide"
uccaguuguaauagaaaccuuga

SEQ ID NO: 2285 - RNA, 23 nt, Artificial Sequence
  source: /note="Description of Artificial Sequence: Synthetic oligonucleotide"
ucacguuaagugcucggagucau

SEQ ID NO: 2286 - RNA, 23 nt, Artificial Sequence
  source: /note="Description of Artificial Sequence: Synthetic oligonucleotide"
ucaggaauccgauucaccagcuc

SEQ ID NO: 2287 - RNA, 23 nt, Artificial Sequence
  source: /note="Description of Artificial Sequence: Synthetic oligonucleotide"
ucacacguguguagcuguugaca

SEQ ID NO: 2288 - RNA, 23 nt, Artificial Sequence
  source: /note="Description of Artificial Sequence: Synthetic oligonucleotide"
uagcgucacauacaucagcucaa

SEQ ID NO: 2289 - RNA, 23 nt, Artificial Sequence
  source: /note="Description of Artificial Sequence: Synthetic oligonucleotide"
uuuucguaaacaagucagcagcc

SEQ ID NO: 2290 - RNA, 23 nt, Artificial Sequence
  source: /note="Description of Artificial Sequence: Synthetic oligonucleotide"
ucacggucuuucuugguagcuga

SEQ ID NO: 2291 - RNA, 23 nt, Artificial Sequence
  source: /note="Description of Artificial Sequence: Synthetic oligonucleotide"
uuaaccuuggaagauuagaaucc

SEQ ID NO: 2292 - RNA, 23 nt, Artificial Sequence
  source: /note="Description of Artificial Sequence: Synthetic oligonucleotide"
uuaacgucaguucauaaaccugg

SEQ ID NO: 2293 - RNA, 23 nt, Artificial Sequence
  source: /note="Description of Artificial Sequence: Synthetic oligonucleotide"
ugcuauaaguuccacaauacucc

SEQ ID NO: 2294 - RNA, 23 nt, Artificial Sequence
  source: /note="Description of Artificial Sequence: Synthetic oligonucleotide"
uuccgaucucgauucagagucau

SEQ ID NO: 2295 - RNA, 23 nt, Artificial Sequence
  source: /note="Description of Artificial Sequence: Synthetic oligonucleotide"
uaaauuuaucaacacugcuguca

SEQ ID NO: 2296 - RNA, 23 nt, Artificial Sequence
  source: /note="Description of Artificial Sequence: Synthetic oligonucleotide"
uaacgaagcagauaaaaggcgga

SEQ ID NO: 2297 - RNA, 23 nt, Artificial Sequence
  source: /note="Description of Artificial Sequence: Synthetic oligonucleotide"
ucaauaggaacuguuccucagag

SEQ ID NO: 2298 - RNA, 23 nt, Artificial Sequence
  source: /note="Description of Artificial Sequence: Synthetic oligonucleotide"
ucaacgguacagcucuuccuaga

SEQ ID NO: 2299 - RNA, 23 nt, Artificial Sequence
  source: /note="Description of Artificial Sequence: Synthetic oligonucleotide"
ugucggaugggacuuagagaagg

SEQ ID NO: 2300 - RNA, 23 nt, Artificial Sequence
  source: /note="Description of Artificial Sequence: Synthetic oligonucleotide"
ucacacggucuuucuugguagcu

SEQ ID NO: 2301 - RNA, 23 nt, Artificial Sequence
  source: /note="Description of Artificial Sequence: Synthetic oligonucleotide"
ucucgagcuguaaccuuggaaga

SEQ ID NO: 2302 - RNA, 23 nt, Artificial Sequence
  source: /note="Description of Artificial Sequence: Synthetic oligonucleotide"
uguaacgucaguucauaaaccug

SEQ ID NO: 2303 - RNA, 23 nt, Artificial Sequence
  source: /note="Description of Artificial Sequence: Synthetic oligonucleotide"
uagcuauaaguuccacaauacuc

SEQ ID NO: 2304 - RNA, 23 nt, Artificial Sequence
  source: /note="Description of Artificial Sequence: Synthetic oligonucleotide"
uauccgaucucgauucagaguca

SEQ ID NO: 2305 - RNA, 23 nt, Artificial Sequence
  source: /note="Description of Artificial Sequence: Synthetic oligonucleotide"
ucucucaacacaaauuuaucaac

SEQ ID NO: 2306 - RNA, 23 nt, Artificial Sequence
  source: /note="Description of Artificial Sequence: Synthetic oligonucleotide"
ugucaagaggaacuuuauagagu

SEQ ID NO: 2307 - RNA, 23 nt, Artificial Sequence
  source: /note="Description of Artificial Sequence: Synthetic oligonucleotide"
uccaauaggaacuguuccucaga

SEQ ID NO: 2308 - RNA, 23 nt, Artificial Sequence
  source: /note="Description of Artificial Sequence: Synthetic oligonucleotide"
ugguuauugugcugacggagaaa

SEQ ID NO: 2309 - RNA, 23 nt, Artificial Sequence
  source: /note="Description of Artificial Sequence: Synthetic oligonucleotide"
uccaacgguacagcucuuccuag

SEQ ID NO: 2310 - RNA, 23 nt, Artificial Sequence
  source: /note="Description of Artificial Sequence: Synthetic oligonucleotide"
ucgguacagaugcuuguucuccu

SEQ ID NO: 2311 - RNA, 23 nt, Artificial Sequence
  source: /note="Description of Artificial Sequence: Synthetic oligonucleotide"
ucacgguucuuugugacacucgu

SEQ ID NO: 2312 - RNA, 23 nt, Artificial Sequence
  source: /note="Description of Artificial Sequence: Synthetic oligonucleotide"
ucauauugucagacaaugauuca

SEQ ID NO: 2313 - RNA, 23 nt, Artificial Sequence
  source: /note="Description of Artificial Sequence: Synthetic oligonucleotide"
ugcucgagcuguaaccuuggaag

SEQ ID NO: 2314 - RNA, 23 nt, Artificial Sequence
  source: /note="Description of Artificial Sequence: Synthetic oligonucleotide"
uauguaacgucaguucauaaacc

SEQ ID NO: 2315 - RNA, 23 nt, Artificial Sequence
  source: /note="Description of Artificial Sequence: Synthetic oligonucleotide"
ucagcuauaaguuccacaauacu

SEQ ID NO: 2316 - RNA, 23 nt, Artificial Sequence
  source: /note="Description of Artificial Sequence: Synthetic oligonucleotide"
ucauccgaucucgauucagaguc

SEQ ID NO: 2317 - RNA, 23 nt, Artificial Sequence
  source: /note="Description of Artificial Sequence: Synthetic oligonucleotide"
uccgguucaguagcuucaucucu

SEQ ID NO: 2318 - RNA, 23 nt, Artificial Sequence
  source: /note="Description of Artificial Sequence: Synthetic oligonucleotide"
ugaucgauguaguucaagauguc

SEQ ID NO: 2319 - RNA, 23 nt, Artificial Sequence
  source: /note="Description of Artificial Sequence: Synthetic oligonucleotide"
ucugguuauugugcugacggaga

SEQ ID NO: 2320 - RNA, 23 nt, Artificial Sequence
  source: /note="Description of Artificial Sequence: Synthetic oligonucleotide"
ucccaacgguacagcucuuccua

SEQ ID NO: 2321 - RNA, 23 nt, Artificial Sequence
  source: /note="Description of Artificial Sequence: Synthetic oligonucleotide"
ucugcacgguucuuugugacacu

SEQ ID NO: 2322 - RNA, 23 nt, Artificial Sequence
  source: /note="Description of Artificial Sequence: Synthetic oligonucleotide"
uucacauauugucagacaaugau

SEQ ID NO: 2323 - RNA, 23 nt, Artificial Sequence
  source: /note="Description of Artificial Sequence: Synthetic oligonucleotide"
uagccauaauuuugggaacagcu

SEQ ID NO: 2324 - RNA, 23 nt, Artificial Sequence
  source: /note="Description of Artificial Sequence: Synthetic oligonucleotide"
uacauuguggucuuggugcugug

SEQ ID NO: 2325 - RNA, 23 nt, Artificial Sequence
  source: /note="Description of Artificial Sequence: Synthetic oligonucleotide"
uccagcuauaaguuccacaauac

SEQ ID NO: 2326 - RNA, 23 nt, Artificial Sequence
  source: /note="Description of Artificial Sequence: Synthetic oligonucleotide"
ucgucuaacacaauuucagaacu

SEQ ID NO: 2327 - RNA, 23 nt, Artificial Sequence
  source: /note="Description of Artificial Sequence: Synthetic oligonucleotide"
ucggacacaauggacaagaggug

SEQ ID NO: 2328 - RNA, 23 nt, Artificial Sequence
  source: /note="Description of Artificial Sequence: Synthetic oligonucleotide"
ucaugaucgauguaguucaagau

SEQ ID NO: 2329 - RNA, 23 nt, Artificial Sequence
  source: /note="Description of Artificial Sequence: Synthetic oligonucleotide"
uauuauugagcacucguucuugc

SEQ ID NO: 2330 - RNA, 23 nt, Artificial Sequence
  source: /note="Description of Artificial Sequence: Synthetic oligonucleotide"
ugcaauaacucuugaaagguuau

SEQ ID NO: 2331 - RNA, 23 nt, Artificial Sequence
  source: /note="Description of Artificial Sequence: Synthetic oligonucleotide"
uccaaugggaaccaagcugacga

SEQ ID NO: 2332 - RNA, 23 nt, Artificial Sequence
  source: /note="Description of Artificial Sequence: Synthetic oligonucleotide"
ugacuaaagcaggauuucaggua

SEQ ID NO: 2333 - RNA, 23 nt, Artificial Sequence
  source: /note="Description of Artificial Sequence: Synthetic oligonucleotide"
ugauuaugaauagcauucuuauc

SEQ ID NO: 2334 - RNA, 23 nt, Artificial Sequence
  source: /note="Description of Artificial Sequence: Synthetic oligonucleotide"
ugauaacuuuguugaggcauucg

SEQ ID NO: 2335 - RNA, 23 nt, Artificial Sequence
  source: /note="Description of Artificial Sequence: Synthetic oligonucleotide"
ucagguucgcuaugaaggccuuu

SEQ ID NO: 2336 - RNA, 23 nt, Artificial Sequence
  source: /note="Description of Artificial Sequence: Synthetic oligonucleotide"
ucaacauuguggucuuggugcug

SEQ ID NO: 2337 - RNA, 23 nt, Artificial Sequence
  source: /note="Description of Artificial Sequence: Synthetic oligonucleotide"
ucgauucagagucauccuccaag

SEQ ID NO: 2338 - RNA, 23 nt, Artificial Sequence
  source: /note="Description of Artificial Sequence: Synthetic oligonucleotide"
uccgucuaacacaauuucagaac

SEQ ID NO: 2339 - RNA, 23 nt, Artificial Sequence
  source: /note="Description of Artificial Sequence: Synthetic oligonucleotide"
ugcggacacaauggacaagaggu

SEQ ID NO: 2340 - RNA, 23 nt, Artificial Sequence
  source: /note="Description of Artificial Sequence: Synthetic oligonucleotide"
ugacaacauuauugagcacucgu

SEQ ID NO: 2341 - RNA, 23 nt, Artificial Sequence
  source: /note="Description of Artificial Sequence: Synthetic oligonucleotide"
ucuaaacuccaaaugcaaacugg

SEQ ID NO: 2342 - RNA, 23 nt, Artificial Sequence
  source: /note="Description of Artificial Sequence: Synthetic oligonucleotide"
ugauccaaugggaaccaagcuga

SEQ ID NO: 2343 - RNA, 23 nt, Artificial Sequence
  source: /note="Description of Artificial Sequence: Synthetic oligonucleotide"
ucgacuaaagcaggauuucaggu

SEQ ID NO: 2344 - RNA, 23 nt, Artificial Sequence
  source: /note="Description of Artificial Sequence: Synthetic oligonucleotide"
ugugauuaugaauagcauucuua

SEQ ID NO: 2345 - RNA, 23 nt, Artificial Sequence
  source: /note="Description of Artificial Sequence: Synthetic oligonucleotide"
uauccaucaaagcuuugauaacu

SEQ ID NO: 2346 - RNA, 23 nt, Artificial Sequence
  source: /note="Description of Artificial Sequence: Synthetic oligonucleotide"
ucacgccaagaaucagcagagug

SEQ ID NO: 2347 - RNA, 23 nt, Artificial Sequence
  source: /note="Description of Artificial Sequence: Synthetic oligonucleotide"
uacaacauuguggucuuggugcu

SEQ ID NO: 2348 - RNA, 23 nt, Artificial Sequence
  source: /note="Description of Artificial Sequence: Synthetic oligonucleotide"
ucucgauucagagucauccucca

SEQ ID NO: 2349 - RNA, 23 nt, Artificial Sequence
  source: /note="Description of Artificial Sequence: Synthetic oligonucleotide"
uaccgucuaacacaauuucagaa

SEQ ID NO: 2350 - RNA, 23 nt, Artificial Sequence
  source: /note="Description of Artificial Sequence: Synthetic oligonucleotide"
ucgaagcagauaaaaggcggaca

SEQ ID NO: 2351 - RNA, 23 nt, Artificial Sequence
  source: /note="Description of Artificial Sequence: Synthetic oligonucleotide"
ucuccaugaucgauguaguucaa

SEQ ID NO: 2352 - RNA, 23 nt, Artificial Sequence
  source: /note="Description of Artificial Sequence: Synthetic oligonucleotide"
ucggagaaaugagauggaggcug

SEQ ID NO: 2353 - RNA, 23 nt, Artificial Sequence
  source: /note="Description of Artificial Sequence: Synthetic oligonucleotide"
uccuaaacuccaaaugcaaacug

SEQ ID NO: 2354 - RNA, 23 nt, Artificial Sequence
  source: /note="Description of Artificial Sequence: Synthetic oligonucleotide"
ucggccaaaaucaaagcaucuug

SEQ ID NO: 2355 - RNA, 23 nt, Artificial Sequence
  source: /note="Description of Artificial Sequence: Synthetic oligonucleotide"
ucucgacuaaagcaggauuucag

SEQ ID NO: 2356 - RNA, 23 nt, Artificial Sequence
  source: /note="Description of Artificial Sequence: Synthetic oligonucleotide"
ucgaaugugauuaugaauagcau

SEQ ID NO: 2357 - RNA, 23 nt, Artificial Sequence
  source: /note="Description of Artificial Sequence: Synthetic oligonucleotide"
uagauuagaauccaucaaagcuu

SEQ ID NO: 2358 - RNA, 23 nt, Artificial Sequence
  source: /note="Description of Artificial Sequence: Synthetic oligonucleotide"
ucauaaaccuggacaagcugcuc

SEQ ID NO: 2359 - RNA, 23 nt, Artificial Sequence
  source: /note="Description of Artificial Sequence: Synthetic oligonucleotide"
ucacaacauuguggucuuggugc

SEQ ID NO: 2360 - RNA, 23 nt, Artificial Sequence
  source: /note="Description of Artificial Sequence: Synthetic oligonucleotide"
uucucgauucagagucauccucc

SEQ ID NO: 2361 - RNA, 23 nt, Artificial Sequence
  source: /note="Description of Artificial Sequence: Synthetic oligonucleotide"
uuaccgucuaacacaauuucaga

SEQ ID NO: 2362 - RNA, 23 nt, Artificial Sequence
  source: /note="Description of Artificial Sequence: Synthetic oligonucleotide"
uacgaagcagauaaaaggcggac

SEQ ID NO: 2363 - RNA, 23 nt, Artificial Sequence
  source: /note="Description of Artificial Sequence: Synthetic oligonucleotide"
uaggaaugcaauccgccaaagaa

SEQ ID NO: 2364 - RNA, 23 nt, Artificial Sequence
  source: /note="Description of Artificial Sequence: Synthetic oligonucleotide"
uacggagaaaugagauggaggcu

SEQ ID NO: 2365 - RNA, 23 nt, Artificial Sequence
  source: /note="Description of Artificial Sequence: Synthetic oligonucleotide"
ucgguacagcucuuccuagacuc

SEQ ID NO: 2366 - RNA, 23 nt, Artificial Sequence
  source: /note="Description of Artificial Sequence: Synthetic oligonucleotide"
ucugcaagcaaguuuccggccaa

SEQ ID NO: 2367 - RNA, 23 nt, Artificial Sequence
  source: /note="Description of Artificial Sequence: Synthetic oligonucleotide"
uaucauugguucucgacuaaagc

SEQ ID NO: 2368 - RNA, 23 nt, Artificial Sequence
  source: /note="Description of Artificial Sequence: Synthetic oligonucleotide"
ucaaacgaaugugauuaugaaua

SEQ ID NO: 2369 - RNA, 23 nt, Artificial Sequence
  source: /note="Description of Artificial Sequence: Synthetic oligonucleotide"
uaaccuuggaagauuagaaucca

SEQ ID NO: 2370 - RNA, 23 nt, Artificial Sequence
  source: /note="Description of Artificial Sequence: Synthetic oligonucleotide"
uaacgucaguucauaaaccugga

SEQ ID NO: 2371 - RNA, 23 nt, Artificial Sequence
  source: /note="Description of Artificial Sequence: Synthetic oligonucleotide"
ucuauaaguuccacaauacuccc

SEQ ID NO: 2372 - RNA, 23 nt, Artificial Sequence
  source: /note="Description of Artificial Sequence: Synthetic oligonucleotide"
uaucucgauucagagucauccuc

SEQ ID NO: 2373 - RNA, 23 nt, Artificial Sequence
  source: /note="Description of Artificial Sequence: Synthetic oligonucleotide"
uguaccgucuaacacaauuucag

SEQ ID NO: 2374 - RNA, 23 nt, Artificial Sequence
  source: /note="Description of Artificial Sequence: Synthetic oligonucleotide"
uaaggaaugcaauccgccaaaga

SEQ ID NO: 2375 - RNA, 23 nt, Artificial Sequence
  source: /note="Description of Artificial Sequence: Synthetic oligonucleotide"
ugacggagaaaugagauggaggc

SEQ ID NO: 2376 - RNA, 23 nt, Artificial Sequence
  source: /note="Description of Artificial Sequence: Synthetic oligonucleotide"
uacgguacagcucuuccuagacu

SEQ ID NO: 2377 - RNA, 23 nt, Artificial Sequence
  source: /note="Description of Artificial Sequence: Synthetic oligonucleotide"
uucggaugggacuuagagaaggg

SEQ ID NO: 2378 - RNA, 23 nt, Artificial Sequence
  source: /note="Description of Artificial Sequence: Synthetic oligonucleotide"
ucaucauugguucucgacuaaag

SEQ ID NO: 2379 - RNA, 23 nt, Artificial Sequence
  source: /note="Description of Artificial Sequence: Synthetic oligonucleotide"
cgacugucucgacagauagcuga

SEQ ID NO: 2380 - RNA, 23 nt, Artificial Sequence
  source: /note="Description of Artificial Sequence: Synthetic oligonucleotide"
uuuuacggaguauguucgucacu

SEQ ID NO: 2381 - RNA, 23 nt, Artificial Sequence
  source: /note="Description of Artificial Sequence: Synthetic oligonucleotide"
ugacuccgagcacuuaacguggc

SEQ ID NO: 2382 - RNA, 23 nt, Artificial Sequence
  source: /note="Description of Artificial Sequence: Synthetic oligonucleotide"
aggcaauucagucucguugugaa

SEQ ID NO: 2383 - RNA, 23 nt, Artificial Sequence
  source: /note="Description of Artificial Sequence: Synthetic oligonucleotide"
aaugccuucaugaugaacucgga

SEQ ID NO: 2384 - RNA, 23 nt, Artificial Sequence
  source: /note="Description of Artificial Sequence: Synthetic oligonucleotide"
gucaacagcuacacacgugugcc

SEQ ID NO: 2385 - RNA, 23 nt, Artificial Sequence
  source: /note="Description of Artificial Sequence: Synthetic oligonucleotide"
gugacgcugacagaacugcgaag

SEQ ID NO: 2386 - RNA, 23 nt, Artificial Sequence
  source: /note="Description of Artificial Sequence: Synthetic oligonucleotide"
ugcugacuuguuuacgaaauguc

SEQ ID NO: 2387 - RNA, 23 nt, Artificial Sequence
  source: /note="Description of Artificial Sequence: Synthetic oligonucleotide"
uaaucacauucguuuguuugaac

SEQ ID NO: 2388 - RNA, 23 nt, Artificial Sequence
  source: /note="Description of Artificial Sequence: Synthetic oligonucleotide"
uucaguuacggguuaauuacugu

SEQ ID NO: 2389 - RNA, 23 nt, Artificial Sequence
  source: /note="Description of Artificial Sequence: Synthetic oligonucleotide"
ugaagcccuuggaguguuaaaua

SEQ ID NO: 2390 - RNA, 23 nt, Artificial Sequence
  source: /note="Description of Artificial Sequence: Synthetic oligonucleotide"
guucugauuucccagucaacuga

SEQ ID NO: 2391 - RNA, 23 nt, Artificial Sequence
  source: /note="Description of Artificial Sequence: Synthetic oligonucleotide"
ucauccaggcaauucagucucgu

SEQ ID NO: 2392 - RNA, 23 nt, Artificial Sequence
  source: /note="Description of Artificial Sequence: Synthetic oligonucleotide"
gcauggucgacauccuugcuugu

SEQ ID NO: 2393 - RNA, 23 nt, Artificial Sequence
  source: /note="Description of Artificial Sequence: Synthetic oligonucleotide"
gccuucaugaugaacucggaguu

SEQ ID NO: 2394 - RNA, 23 nt, Artificial Sequence
  source: /note="Description of Artificial Sequence: Synthetic oligonucleotide"
uggaccagucguacucaguuuga

SEQ ID NO: 2395 - RNA, 23 nt, Artificial Sequence
  source: /note="Description of Artificial Sequence: Synthetic oligonucleotide"
ugacgcugacagaacugcgaagg

SEQ ID NO: 2396 - RNA, 23 nt, Artificial Sequence
  source: /note="Description of Artificial Sequence: Synthetic oligonucleotide"
auucagaucagguguuuauuggc

SEQ ID NO: 2397 - RNA, 23 nt, Artificial Sequence
  source: /note="Description of Artificial Sequence: Synthetic oligonucleotide"
aagcccuuggaguguuaaauaca

SEQ ID NO: 2398 - RNA, 23 nt, Artificial Sequence
  source: /note="Description of Artificial Sequence: Synthetic oligonucleotide"
cuucaagucuggaauguuccgga

SEQ ID NO: 2399 - RNA, 23 nt, Artificial Sequence
  source: /note="Description of Artificial Sequence: Synthetic oligonucleotide"
cauccaggcaauucagucucguu

SEQ ID NO: 2400 - RNA, 23 nt, Artificial Sequence
  source: /note="Description of Artificial Sequence: Synthetic oligonucleotide"
uggucgacauccuugcuugucgc

SEQ ID NO: 2401 - RNA, 23 nt, Artificial Sequence
  source: /note="Description of Artificial Sequence: Synthetic oligonucleotide"
gccugcuagcuccaugcuuaagc

SEQ ID NO: 2402 - RNA, 23 nt, Artificial Sequence
  source: /note="Description of Artificial Sequence: Synthetic oligonucleotide"
ggaccagucguacucaguuugaa

SEQ ID NO: 2403 - RNA, 23 nt, Artificial Sequence
  source: /note="Description of Artificial Sequence: Synthetic oligonucleotide"
aggaaaggagaaagucaguccgg

SEQ ID NO: 2404 - RNA, 23 nt, Artificial Sequence
  source: /note="Description of Artificial Sequence: Synthetic oligonucleotide"
uauuggcuuuguauugaaacagu

SEQ ID NO: 2405 - RNA, 23 nt, Artificial Sequence
  source: /note="Description of Artificial Sequence: Synthetic oligonucleotide"
gguagacaugcuuuuacggagua

SEQ ID NO: 2406 - RNA, 23 nt, Artificial Sequence
  source: /note="Description of Artificial Sequence: Synthetic oligonucleotide"
uucaagucuggaauguuccggag

SEQ ID NO: 2407 - RNA, 23 nt, Artificial Sequence
  source: /note="Description of Artificial Sequence: Synthetic oligonucleotide"
auccaggcaauucagucucguug

SEQ ID NO: 2408 - RNA, 23 nt, Artificial Sequence
  source: /note="Description of Artificial Sequence: Synthetic oligonucleotide"
ccugcuagcuccaugcuuaagcc

SEQ ID NO: 2409 - RNA, 23 nt, Artificial Sequence
  source: /note="Description of Artificial Sequence: Synthetic oligonucleotide"
guagaacuucagacccuaauccu

SEQ ID NO: 2410 - RNA, 23 nt, Artificial Sequence
  source: /note="Description of Artificial Sequence: Synthetic oligonucleotide"
uuucuaugcccguguaaaguaug

SEQ ID NO: 2411 - RNA, 23 nt, Artificial Sequence
  source: /note="Description of Artificial Sequence: Synthetic oligonucleotide"
ucuuaugaacgcuaucauucaaa

SEQ ID NO: 2412 - RNA, 23 nt, Artificial Sequence
  source: /note="Description of Artificial Sequence: Synthetic oligonucleotide"
agacaugcuuuuacggaguaugu

SEQ ID NO: 2413 - RNA, 23 nt, Artificial Sequence
  source: /note="Description of Artificial Sequence: Synthetic oligonucleotide"
ccagcacaaaguuacuuaguccc

SEQ ID NO: 2414 - RNA, 23 nt, Artificial Sequence
  source: /note="Description of Artificial Sequence: Synthetic oligonucleotide"
uccaggcaauucagucucguugu

SEQ ID NO: 2415 - RNA, 23 nt, Artificial Sequence
  source: /note="Description of Artificial Sequence: Synthetic oligonucleotide"
ccaugcaagacucacuuaguccc

SEQ ID NO: 2416 - RNA, 23 nt, Artificial Sequence
  source: /note="Description of Artificial Sequence: Synthetic oligonucleotide"
cuacuggagcaaguugaaugauc

SEQ ID NO: 2417 - RNA, 23 nt, Artificial Sequence
  source: /note="Description of Artificial Sequence: Synthetic oligonucleotide"
caucaugaacaaagucaucggag

SEQ ID NO: 2418 - RNA, 23 nt, Artificial Sequence
  source: /note="Description of Artificial Sequence: Synthetic oligonucleotide"
uucuaugcccguguaaaguaugu

SEQ ID NO: 2419 - RNA, 23 nt, Artificial Sequence
  source: /note="Description of Artificial Sequence: Synthetic oligonucleotide"
aaaagcuuuaaaacaguacacga

SEQ ID NO: 2420 - RNA, 23 nt, Artificial Sequence
  source: /note="Description of Artificial Sequence: Synthetic oligonucleotide"
ugaacgcuaucauucaaaacaga

SEQ ID NO: 2421 - RNA, 23 nt, Artificial Sequence
  source: /note="Description of Artificial Sequence: Synthetic oligonucleotide"
ugcuuuuacggaguauguucguc

SEQ ID NO: 2422 - RNA, 23 nt, Artificial Sequence
  source: /note="Description of Artificial Sequence: Synthetic oligonucleotide"
gaagaggaggauucugacuuggc

SEQ ID NO: 2423 - RNA, 23 nt, Artificial Sequence
  source: /note="Description of Artificial Sequence: Synthetic oligonucleotide"
ccaggcaauucagucucguugug

SEQ ID NO: 2424 - RNA, 23 nt, Artificial Sequence
  source: /note="Description of Artificial Sequence: Synthetic oligonucleotide"
gucacuggaaacagugaguccgg

SEQ ID NO: 2425 - RNA, 23 nt, Artificial Sequence
  source: /note="Description of Artificial Sequence: Synthetic oligonucleotide"
cuugucaacagcuacacacgugu

SEQ ID NO: 2426 - RNA, 23 nt, Artificial Sequence
  source: /note="Description of Artificial Sequence: Synthetic oligonucleotide"
ggaagcugagcauuaucagaggg

SEQ ID NO: 2427 - RNA, 23 nt, Artificial Sequence
  source: /note="Description of Artificial Sequence: Synthetic oligonucleotide"
accggcugcugacuuguuuacga

SEQ ID NO: 2428 - RNA, 23 nt, Artificial Sequence
  source: /note="Description of Artificial Sequence: Synthetic oligonucleotide"
acccgcugacauuuccguuguac

SEQ ID NO: 2429 - RNA, 23 nt, Artificial Sequence
  source: /note="Description of Artificial Sequence: Synthetic oligonucleotide"
gcagcugguucaguuacggguua

SEQ ID NO: 2430 - RNA, 23 nt, Artificial Sequence
  source: /note="Description of Artificial Sequence: Synthetic oligonucleotide"
aaguggaagcgacugucucgaca

SEQ ID NO: 2431 - RNA, 23 nt, Artificial Sequence
  source: /note="Description of Artificial Sequence: Synthetic oligonucleotide"
gcuuuuacggaguauguucguca

SEQ ID NO: 2432 - RNA, 23 nt, Artificial Sequence
  source: /note="Description of Artificial Sequence: Synthetic oligonucleotide"
ugcaauagagaaauaguacgaag

SEQ ID NO: 2433 - RNA, 23 nt, Artificial Sequence
  source: /note="Description of Artificial Sequence: Synthetic oligonucleotide"
caggcaauucagucucguuguga

SEQ ID NO: 2434 - RNA, 23 nt, Artificial Sequence
  source: /note="Description of Artificial Sequence: Synthetic oligonucleotide"
agagcuggugaaucggauuccug

SEQ ID NO: 2435 - RNA, 23 nt, Artificial Sequence
  source: /note="Description of Artificial Sequence: Synthetic oligonucleotide"
uugucaacagcuacacacgugug

SEQ ID NO: 2436 - RNA, 23 nt, Artificial Sequence
  source: /note="Description of Artificial Sequence: Synthetic oligonucleotide"
guuugagcugauguaugugacgc

SEQ ID NO: 2437 - RNA, 23 nt, Artificial Sequence
  source: /note="Description of Artificial Sequence: Synthetic oligonucleotide"
ccggcugcugacuuguuuacgaa

SEQ ID NO: 2438 - RNA, 23 nt, Artificial Sequence
  source: /note="Description of Artificial Sequence: Synthetic oligonucleotide"
gcgacugucucgacagauagcug

SEQ ID NO: 2439 - RNA, 23 nt, Artificial Sequence
  source: /note="Description of Artificial Sequence: Synthetic oligonucleotide"
cuuuuacggaguauguucgucac

SEQ ID NO: 2440 - RNA, 23 nt, Artificial Sequence
  source: /note="Description of Artificial Sequence: Synthetic oligonucleotide"
ucaagguuucuauuacaacuggu

SEQ ID NO: 2441 - RNA, 23 nt, Artificial Sequence
  source: /note="Description of Artificial Sequence: Synthetic oligonucleotide"
augacuccgagcacuuaacgugg

SEQ ID NO: 2442 - RNA, 23 nt, Artificial Sequence
  source: /note="Description of Artificial Sequence: Synthetic oligonucleotide"
gagcuggugaaucggauuccugc

SEQ ID NO: 2443 - RNA, 23 nt, Artificial Sequence
  source: /note="Description of Artificial Sequence: Synthetic oligonucleotide"
ugucaacagcuacacacgugugc

SEQ ID NO: 2444 - RNA, 23 nt, Artificial Sequence
  source: /note="Description of Artificial Sequence: Synthetic oligonucleotide"
uugagcugauguaugugacgcug

SEQ ID NO: 2445 - RNA, 23 nt, Artificial Sequence
  source: /note="Description of Artificial Sequence: Synthetic oligonucleotide"
ucagcuaccaagaaagaccgugu

SEQ ID NO: 2446 - RNA, 23 nt, Artificial Sequence
  source: /note="Description of Artificial Sequence: Synthetic oligonucleotide"
ggaguauuguggaacuuauagcu

SEQ ID NO: 2447 - RNA, 23 nt, Artificial Sequence
  source: /note="Description of Artificial Sequence: Synthetic oligonucleotide"
augacucugaaucgagaucggau

SEQ ID NO: 2448 - RNA, 23 nt, Artificial Sequence
  source: /note="Description of Artificial Sequence: Synthetic oligonucleotide"
ucuaggaagagcuguaccguugg

SEQ ID NO: 2449 - RNA, 23 nt, Artificial Sequence
  source: /note="Description of Artificial Sequence: Synthetic oligonucleotide"
ccuucucuaagucccauccgacg

SEQ ID NO: 2450 - RNA, 23 nt, Artificial Sequence
  source: /note="Description of Artificial Sequence: Synthetic oligonucleotide"
agcuaccaagaaagaccguguga

SEQ ID NO: 2451 - RNA, 23 nt, Artificial Sequence
  source: /note="Description of Artificial Sequence: Synthetic oligonucleotide"
ucuuccaagguuacagcucgagc

SEQ ID NO: 2452 - RNA, 23 nt, Artificial Sequence
  source: /note="Description of Artificial Sequence: Synthetic oligonucleotide"
cagguuuaugaacugacguuaca

SEQ ID NO: 2453 - RNA, 23 nt, Artificial Sequence
  source: /note="Description of Artificial Sequence: Synthetic oligonucleotide"
gaguauuguggaacuuauagcug

SEQ ID NO: 2454 - RNA, 23 nt, Artificial Sequence
  source: /note="Description of Artificial Sequence: Synthetic oligonucleotide"
guugauaaauuuguguugagaga

SEQ ID NO: 2455 - RNA, 23 nt, Artificial Sequence
  source: /note="Description of Artificial Sequence: Synthetic oligonucleotide"
ucugaggaacaguuccuauuggc

SEQ ID NO: 2456 - RNA, 23 nt, Artificial Sequence
  source: /note="Description of Artificial Sequence: Synthetic oligonucleotide"
uuucuccgucagcacaauaacca

SEQ ID NO: 2457 - RNA, 23 nt, Artificial Sequence
  source: /note="Description of Artificial Sequence: Synthetic oligonucleotide"
cuaggaagagcuguaccguuggg

SEQ ID NO: 2458 - RNA, 23 nt, Artificial Sequence
  source: /note="Description of Artificial Sequence: Synthetic oligonucleotide"
aggagaacaagcaucuguaccgu

SEQ ID NO: 2459 - RNA, 23 nt, Artificial Sequence
  source: /note="Description of Artificial Sequence: Synthetic oligonucleotide"
acgagugucacaaagaaccgugc

SEQ ID NO: 2460 - RNA, 23 nt, Artificial Sequence
  source: /note="Description of Artificial Sequence: Synthetic oligonucleotide"
ugaaucauugucugacaauaugu

SEQ ID NO: 2461 - RNA, 23 nt, Artificial Sequence
  source: /note="Description of Artificial Sequence: Synthetic oligonucleotide"
cuuccaagguuacagcucgagcu

SEQ ID NO: 2462 - RNA, 23 nt, Artificial Sequence
  source: /note="Description of Artificial Sequence: Synthetic oligonucleotide"
gguuuaugaacugacguuacauc

SEQ ID NO: 2463 - RNA, 23 nt, Artificial Sequence
  source: /note="Description of Artificial Sequence: Synthetic oligonucleotide"
aguauuguggaacuuauagcugg

SEQ ID NO: 2464 - RNA, 23 nt, Artificial Sequence
  source: /note="Description of Artificial Sequence: Synthetic oligonucleotide"
gacucugaaucgagaucggaugu

SEQ ID NO: 2465 - RNA, 23 nt, Artificial Sequence
  source: /note="Description of Artificial Sequence: Synthetic oligonucleotide"
agagaugaagcuacugaaccggg

SEQ ID NO: 2466 - RNA, 23 nt, Artificial Sequence
  source: /note="Description of Artificial Sequence: Synthetic oligonucleotide"
gacaucuugaacuacaucgauca

SEQ ID NO: 2467 - RNA, 23 nt, Artificial Sequence
  source: /note="Description of Artificial Sequence: Synthetic oligonucleotide"
ucuccgucagcacaauaaccaga

SEQ ID NO: 2468 - RNA, 23 nt, Artificial Sequence
  source: /note="Description of Artificial Sequence: Synthetic oligonucleotide"
uaggaagagcuguaccguuggga

SEQ ID NO: 2469 - RNA, 23 nt, Artificial Sequence
  source: /note="Description of Artificial Sequence: Synthetic oligonucleotide"
agugucacaaagaaccgugcaga

SEQ ID NO: 2470 - RNA, 23 nt, Artificial Sequence
  source: /note="Description of Artificial Sequence: Synthetic oligonucleotide"
agcuguucccaaaauuauggcuu

SEQ ID NO: 2471 - RNA, 23 nt, Artificial Sequence
  source: /note="Description of Artificial Sequence: Synthetic oligonucleotide"
cacagcaccaagaccacaauguu

SEQ ID NO: 2472 - RNA, 23 nt, Artificial Sequence
  source: /note="Description of Artificial Sequence: Synthetic oligonucleotide"
guauuguggaacuuauagcugga

SEQ ID NO: 2473 - RNA, 23 nt, Artificial Sequence
  source: /note="Description of Artificial Sequence: Synthetic oligonucleotide"
aguucugaaauuguguuagacgg

SEQ ID NO: 2474 - RNA, 23 nt, Artificial Sequence
  source: /note="Description of Artificial Sequence: Synthetic oligonucleotide"
caccucuuguccauuguguccgc

SEQ ID NO: 2475 - RNA, 23 nt, Artificial Sequence
  source: /note="Description of Artificial Sequence: Synthetic oligonucleotide"
gcaagaacgagugcucaauaaug

SEQ ID NO: 2476 - RNA, 23 nt, Artificial Sequence
  source: /note="Description of Artificial Sequence: Synthetic oligonucleotide"
auaaccuuucaagaguuauugca

SEQ ID NO: 2477 - RNA, 23 nt, Artificial Sequence
  source: /note="Description of Artificial Sequence: Synthetic oligonucleotide"
ucgucagcuugguucccauugga

SEQ ID NO: 2478 - RNA, 23 nt, Artificial Sequence
  source: /note="Description of Artificial Sequence: Synthetic oligonucleotide"
gauaagaaugcuauucauaauca

SEQ ID NO: 2479 - RNA, 23 nt, Artificial Sequence
  source: /note="Description of Artificial Sequence: Synthetic oligonucleotide"
cgaaugccucaacaaaguuauca

SEQ ID NO: 2480 - RNA, 23 nt, Artificial Sequence
  source: /note="Description of Artificial Sequence: Synthetic oligonucleotide"
aaaggccuucauagcgaaccuga

SEQ ID NO: 2481 - RNA, 23 nt, Artificial Sequence
  source: /note="Description of Artificial Sequence: Synthetic oligonucleotide"
cagcaccaagaccacaauguugu

SEQ ID NO: 2482 - RNA, 23 nt, Artificial Sequence
  source: /note="Description of Artificial Sequence: Synthetic oligonucleotide"
cuuggaggaugacucugaaucga

SEQ ID NO: 2483 - RNA, 23 nt, Artificial Sequence
  source: /note="Description of Artificial Sequence: Synthetic oligonucleotide"
accucuuguccauuguguccgcc

SEQ ID NO: 2484 - RNA, 23 nt, Artificial Sequence
  source: /note="Description of Artificial Sequence: Synthetic oligonucleotide"
acgagugcucaauaauguuguca

SEQ ID NO: 2485 - RNA, 23 nt, Artificial Sequence
  source: /note="Description of Artificial Sequence: Synthetic oligonucleotide"
ccaguuugcauuuggaguuuagg

SEQ ID NO: 2486 - RNA, 23 nt, Artificial Sequence
  source: /note="Description of Artificial Sequence: Synthetic oligonucleotide"
ucagcuugguucccauuggaucu

SEQ ID NO: 2487 - RNA, 23 nt, Artificial Sequence
  source: /note="Description of Artificial Sequence: Synthetic oligonucleotide"
accugaaauccugcuuuagucga

SEQ ID NO: 2488 - RNA, 23 nt, Artificial Sequence
  source: /note="Description of Artificial Sequence: Synthetic oligonucleotide"
aguuaucaaagcuuugauggauu

SEQ ID NO: 2489 - RNA, 23 nt, Artificial Sequence
  source: /note="Description of Artificial Sequence: Synthetic oligonucleotide"
cacucugcugauucuuggcgugc

SEQ ID NO: 2490 - RNA, 23 nt, Artificial Sequence
  source: /note="Description of Artificial Sequence: Synthetic oligonucleotide"
agcaccaagaccacaauguugug

SEQ ID NO: 2491 - RNA, 23 nt, Artificial Sequence
  source: /note="Description of Artificial Sequence: Synthetic oligonucleotide"
uggaggaugacucugaaucgaga

SEQ ID NO: 2492 - RNA, 23 nt, Artificial Sequence
  source: /note="Description of Artificial Sequence: Synthetic oligonucleotide"
uguccgccuuuuaucugcuucgu

SEQ ID NO: 2493 - RNA, 23 nt, Artificial Sequence
  source: /note="Description of Artificial Sequence: Synthetic oligonucleotide"
uugaacuacaucgaucauggaga

SEQ ID NO: 2494 - RNA, 23 nt, Artificial Sequence
  source: /note="Description of Artificial Sequence: Synthetic oligonucleotide"
cagccuccaucucauuucuccgu

SEQ ID NO: 2495 - RNA, 23 nt, Artificial Sequence
  source: /note="Description of Artificial Sequence: Synthetic oligonucleotide"
caguuugcauuuggaguuuaggu

SEQ ID NO: 2496 - RNA, 23 nt, Artificial Sequence
  source: /note="Description of Artificial Sequence: Synthetic oligonucleotide"
caagaugcuuugauuuuggccgg

SEQ ID NO: 2497 - RNA, 23 nt, Artificial Sequence
  source: /note="Description of Artificial Sequence: Synthetic oligonucleotide"
cugaaauccugcuuuagucgaga

SEQ ID NO: 2498 - RNA, 23 nt, Artificial Sequence
  source: /note="Description of Artificial Sequence: Synthetic oligonucleotide"
gagcagcuuguccagguuuauga

SEQ ID NO: 2499 - RNA, 23 nt, Artificial Sequence
  source: /note="Description of Artificial Sequence: Synthetic oligonucleotide"
gcaccaagaccacaauguuguga

SEQ ID NO: 2500 - RNA, 23 nt, Artificial Sequence
  source: /note="Description of Artificial Sequence: Synthetic oligonucleotide"
ggaggaugacucugaaucgagau

SEQ ID NO: 2501 - RNA, 23 nt, Artificial Sequence
  source: /note="Description of Artificial Sequence: Synthetic oligonucleotide"
guccgccuuuuaucugcuucguu

SEQ ID NO: 2502 - RNA, 23 nt, Artificial Sequence
  source: /note="Description of Artificial Sequence: Synthetic oligonucleotide"
uucuuuggcggauugcauuccuu

SEQ ID NO: 2503 - RNA, 23 nt, Artificial Sequence
  source: /note="Description of Artificial Sequence: Synthetic oligonucleotide"
agccuccaucucauuucuccguc

SEQ ID NO: 2504 - RNA, 23 nt, Artificial Sequence
  source: /note="Description of Artificial Sequence: Synthetic oligonucleotide"
gagucuaggaagagcuguaccgu

SEQ ID NO: 2505 - RNA, 23 nt, Artificial Sequence
  source: /note="Description of Artificial Sequence: Synthetic oligonucleotide"
uuggccggaaacuugcuugcagc

SEQ ID NO: 2506 - RNA, 23 nt, Artificial Sequence
  source: /note="Description of Artificial Sequence: Synthetic oligonucleotide"
gcuuuagucgagaaccaaugaug

SEQ ID NO: 2507 - RNA, 23 nt, Artificial Sequence
  source: /note="Description of Artificial Sequence: Synthetic oligonucleotide"
gaggaugacucugaaucgagauc

SEQ ID NO: 2508 - RNA, 23 nt, Artificial Sequence
  source: /note="Description of Artificial Sequence: Synthetic oligonucleotide"
cugaaauuguguuagacgguacc

SEQ ID NO: 2509 - RNA, 23 nt, Artificial Sequence
  source: /note="Description of Artificial Sequence: Synthetic oligonucleotide"
ucuuuggcggauugcauuccuuu

SEQ ID NO: 2510 - RNA, 23 nt, Artificial Sequence
  source: /note="Description of Artificial Sequence: Synthetic oligonucleotide"
gccuccaucucauuucuccguca

SEQ ID NO: 2511 - RNA, 23 nt, Artificial Sequence
  source: /note="Description of Artificial Sequence: Synthetic oligonucleotide"
agucuaggaagagcuguaccguu

SEQ ID NO: 2512 - RNA, 23 nt, Artificial Sequence
  source: /note="Description of Artificial Sequence: Synthetic oligonucleotide"
cccuucucuaagucccauccgac

SEQ ID NO: 2513 - RNA, 23 nt, Artificial Sequence
  source: /note="Description of Artificial Sequence: Synthetic oligonucleotide"
cuuuagucgagaaccaaugaugg

SEQ ID NO: 2514 - RNA, 21 nt, Artificial Sequence
  source: /note="Description of Artificial Sequence: Synthetic oligonucleotide"
uaccaagaaagaccgugugaa

SEQ ID NO: 2515 - RNA, 21 nt, Artificial Sequence
  source: /note="Description of Artificial Sequence: Synthetic oligonucleotide"
ucaacaaaguuaucaaagcua

SEQ ID NO: 2516 - RNA, 21 nt, Artificial Sequence
  source: /note="Description of Artificial Sequence: Synthetic oligonucleotide"
caacaaaguuaucaaagcuua

SEQ ID NO: 2517 - RNA, 21 nt, Artificial Sequence
  source: /note="Description of Artificial Sequence: Synthetic oligonucleotide"
auggauucuaaucuuccaaga

SEQ ID NO: 2518 - RNA, 21 nt, Artificial Sequence
  source: /note="Description of Artificial Sequence: Synthetic oligonucleotide"
uguucccaaaauuauggcuua

SEQ ID NO: 2519 - RNA, 21 nt, Artificial Sequence
  source: /note="Description of Artificial Sequence: Synthetic oligonucleotide"
ccagguuuaugaacugacgua

SEQ ID NO: 2520 - RNA, 21 nt, Artificial Sequence
  source: /note="Description of Artificial Sequence: Synthetic oligonucleotide"
guuuaugaacugacguuacaa

SEQ ID NO: 2521 - RNA, 21 nt, Artificial Sequence
  source: /note="Description of Artificial Sequence: Synthetic oligonucleotide"
gcagcagcucuucagaacgca

SEQ ID NO: 2522 - RNA, 21 nt, Artificial Sequence
  source: /note="Description of Artificial Sequence: Synthetic oligonucleotide"
ucugaaucgagaucggaugua

SEQ ID NO: 2523 - RNA, 21 nt, Artificial Sequence
  source: /note="Description of Artificial Sequence: Synthetic oligonucleotide"
cgguaccgacaaccaguauua

SEQ ID NO: 2524 - RNA, 21 nt, Artificial Sequence
  source: /note="Description of Artificial Sequence: Synthetic oligonucleotide"
caaacucuauaaaguuccuca

SEQ ID NO: 2525 - RNA, 21 nt, Artificial Sequence
  source: /note="Description of Artificial Sequence: Synthetic oligonucleotide"
aucuugaacuacaucgaucaa

SEQ ID NO: 2526 - RNA, 21 nt, Artificial Sequence
  source: /note="Description of Artificial Sequence: Synthetic oligonucleotide"
ucuugaacuacaucgaucaua

SEQ ID NO: 2527 - RNA, 21 nt, Artificial Sequence
  source: /note="Description of Artificial Sequence: Synthetic oligonucleotide"
uuggcggauugcauuccuuua

SEQ ID NO: 2528 - RNA, 21 nt, Artificial Sequence
  source: /note="Description of Artificial Sequence: Synthetic oligonucleotide"
gcuacagugaguuaggacuga

SEQ ID NO: 2529 - RNA, 21 nt, Artificial Sequence
  source: /note="Description of Artificial Sequence: Synthetic oligonucleotide"
cucugaggaacaguuccuaua

SEQ ID NO: 2530 - RNA, 21 nt, Artificial Sequence
  source: /note="Description of Artificial Sequence: Synthetic oligonucleotide"
gaggaacaguuccuauuggca

SEQ ID NO: 2531 - RNA, 21 nt, Artificial Sequence
  source: /note="Description of Artificial Sequence: Synthetic oligonucleotide"
cuccgucagcacaauaaccaa

SEQ ID NO: 2532 - RNA, 21 nt, Artificial Sequence
  source: /note="Description of Artificial Sequence: Synthetic oligonucleotide"
agaggcuauaaccuacuacca

SEQ ID NO: 2533 - RNA, 21 nt, Artificial Sequence
  source: /note="Description of Artificial Sequence: Synthetic oligonucleotide"
accuacuaccaagcauaacaa

SEQ ID NO: 2534 - RNA, 21 nt, Artificial Sequence
  source: /note="Description of Artificial Sequence: Synthetic oligonucleotide"
cagaugagucuaggaagagca

SEQ ID NO: 2535 - RNA, 21 nt, Artificial Sequence
  source: /note="Description of Artificial Sequence: Synthetic oligonucleotide"
aacaagcaucuguaccguuga

SEQ ID NO: 2536 - RNA, 21 nt, Artificial Sequence
  source: /note="Description of Artificial Sequence: Synthetic oligonucleotide"
agcaucuguaccguugaguca

SEQ ID NO: 2537 - RNA, 21 nt, Artificial Sequence
  source: /note="Description of Artificial Sequence: Synthetic oligonucleotide"
gcagcuucuagacaaucugaa

SEQ ID NO: 2538 - RNA, 21 nt, Artificial Sequence
  source: /note="Description of Artificial Sequence: Synthetic oligonucleotide"
ucagguccuguuacaacaaga

SEQ ID NO: 2539 - RNA, 21 nt, Artificial Sequence
  source: /note="Description of Artificial Sequence: Synthetic oligonucleotide"
caaguaaauccucaucacuga

SEQ ID NO: 2540 - RNA, 21 nt, Artificial Sequence
  source: /note="Description of Artificial Sequence: Synthetic oligonucleotide"
uucauaccucaaacugcauga

SEQ ID NO: 2541 - RNA, 21 nt, Artificial Sequence
  source: /note="Description of Artificial Sequence: Synthetic oligonucleotide"
accucaaacugcaugauguca

SEQ ID NO: 2542 - RNA, 21 nt, Artificial Sequence
  source: /note="Description of Artificial Sequence: Synthetic oligonucleotide"
caggacauugggaagugugua

SEQ ID NO: 2543 - RNA, 21 nt, Artificial Sequence
  source: /note="Description of Artificial Sequence: Synthetic oligonucleotide"
aauccugcuuuagucgagaaa

SEQ ID NO: 2544 - RNA, 21 nt, Artificial Sequence
  source: /note="Description of Artificial Sequence: Synthetic oligonucleotide"
gauggcaacuguuuguguuca

SEQ ID NO: 2545 - RNA, 21 nt, Artificial Sequence
  source: /note="Description of Artificial Sequence: Synthetic oligonucleotide"
agugucacaaagaaccgugca

SEQ ID NO: 2546 - RNA, 21 nt, Artificial Sequence
  source: /note="Description of Artificial Sequence: Synthetic oligonucleotide"
gcuuuaaaacaguacacgaca

SEQ ID NO: 2547 - RNA, 21 nt, Artificial Sequence
  source: /note="Description of Artificial Sequence: Synthetic oligonucleotide"
gcugguucaguuacggguuaa

SEQ ID NO: 2548 - RNA, 21 nt, Artificial Sequence
  source: /note="Description of Artificial Sequence: Synthetic oligonucleotide"
ugguucaguuacggguuaaua

SEQ ID NO: 2549 - RNA, 21 nt, Artificial Sequence
  source: /note="Description of Artificial Sequence: Synthetic oligonucleotide"
uuacggguuaauuacugucua

SEQ ID NO: 2550 - RNA, 21 nt, Artificial Sequence
  source: /note="Description of Artificial Sequence: Synthetic oligonucleotide"
gcgacugucucgacagauaga

SEQ ID NO: 2551 - RNA, 21 nt, Artificial Sequence
  source: /note="Description of Artificial Sequence: Synthetic oligonucleotide"
cgacugucucgacagauagca

SEQ ID NO: 2552 - RNA, 21 nt, Artificial Sequence
  source: /note="Description of Artificial Sequence: Synthetic oligonucleotide"
cccaauguuagccaaacagca

SEQ ID NO: 2553 - RNA, 21 nt, Artificial Sequence
  source: /note="Description of Artificial Sequence: Synthetic oligonucleotide"
cacauugacucucaugaagca

SEQ ID NO: 2554 - RNA, 21 nt, Artificial Sequence
  source: /note="Description of Artificial Sequence: Synthetic oligonucleotide"
gagcacuguucaacuguggaa

SEQ ID NO: 2555 - RNA, 21 nt, Artificial Sequence
  source: /note="Description of Artificial Sequence: Synthetic oligonucleotide"
gugagcagcaacauacuuuca

SEQ ID NO: 2556 - RNA, 21 nt, Artificial Sequence
  source: /note="Description of Artificial Sequence: Synthetic oligonucleotide"
cugcuugucaaccacaccgaa

SEQ ID NO: 2557 - RNA, 21 nt, Artificial Sequence
  source: /note="Description of Artificial Sequence: Synthetic oligonucleotide"
uccgagcacuuaacguggcua

SEQ ID NO: 2558 - RNA, 21 nt, Artificial Sequence
  source: /note="Description of Artificial Sequence: Synthetic oligonucleotide"
ccuccaguacaggacuucaua

SEQ ID NO: 2559 - RNA, 21 nt, Artificial Sequence
  source: /note="Description of Artificial Sequence: Synthetic oligonucleotide"
ggucgacauccuugcuuguca

SEQ ID NO: 2560 - RNA, 21 nt, Artificial Sequence
  source: /note="Description of Artificial Sequence: Synthetic oligonucleotide"
cuggacagguuucgucucuca

SEQ ID NO: 2561 - RNA, 21 nt, Artificial Sequence
  source: /note="Description of Artificial Sequence: Synthetic oligonucleotide"
ugucacuggaaacagugagua

SEQ ID NO: 2562 - RNA, 21 nt, Artificial Sequence
  source: /note="Description of Artificial Sequence: Synthetic oligonucleotide"
aacucggaguucaaccuaaga

SEQ ID NO: 2563 - RNA, 21 nt, Artificial Sequence
  source: /note="Description of Artificial Sequence: Synthetic oligonucleotide"
acucggaguucaaccuaagca

SEQ ID NO: 2564 - RNA, 21 nt, Artificial Sequence
  source: /note="Description of Artificial Sequence: Synthetic oligonucleotide"
cucggaguucaaccuaagcca

SEQ ID NO: 2565 - RNA, 21 nt, Artificial Sequence
  source: /note="Description of Artificial Sequence: Synthetic oligonucleotide"
cuggagcaaguugaaugauca

SEQ ID NO: 2566 - RNA, 21 nt, Artificial Sequence
  source: /note="Description of Artificial Sequence: Synthetic oligonucleotide"
agagcagcuucuuaguccaga

SEQ ID NO: 2567 - RNA, 21 nt, Artificial Sequence
  source: /note="Description of Artificial Sequence: Synthetic oligonucleotide"
cuugucaacagcuacacacga

SEQ ID NO: 2568 - RNA, 21 nt, Artificial Sequence
  source: /note="Description of Artificial Sequence: Synthetic oligonucleotide"
cuuuaaggaguucaucuacca

SEQ ID NO: 2569 - RNA, 21 nt, Artificial Sequence
  source: /note="Description of Artificial Sequence: Synthetic oligonucleotide"
ggaccagucguacucaguuua

SEQ ID NO: 2570 - RNA, 21 nt, Artificial Sequence
  source: /note="Description of Artificial Sequence: Synthetic oligonucleotide"
ucauugagaacuauccucuga

SEQ ID NO: 2571 - RNA, 21 nt, Artificial Sequence
  source: /note="Description of Artificial Sequence: Synthetic oligonucleotide"
ugcugacuuguuuacgaaaua

SEQ ID NO: 2572 - RNA, 21 nt, Artificial Sequence
  source: /note="Description of Artificial Sequence: Synthetic oligonucleotide"
cugacauuuccguuguacaua

SEQ ID NO: 2573 - RNA, 21 nt, Artificial Sequence
  source: /note="Description of Artificial Sequence: Synthetic oligonucleotide"
uccguuguacauguuccugua

SEQ ID NO: 2574 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacggtcuuucuugguagcuga

SEQ ID NO: 2575 - RNA, 23 nt, Artificial Sequence
  source: /note="Description of Artificial Sequence: Synthetic oligonucleotide"
uucacacggucuuucuugguagc

SEQ ID NO: 2576 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuutgauaacuuuguugagg

SEQ ID NO: 2577 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagcutugauaacuuuguugag

SEQ ID NO: 2578 - RNA, 23 nt, Artificial Sequence
  source: /note="Description of Artificial Sequence: Synthetic oligonucleotide"
ucuuggaagauuagaauccauca

SEQ ID NO: 2579 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaacctuggaagauuagaaucc

SEQ ID NO: 2580 - RNA, 23 nt, Artificial Sequence
  source: /note="Description of Artificial Sequence: Synthetic oligonucleotide"
uaagccauaauuuugggaacagc

SEQ ID NO: 2581 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggutcgcuaugaaggccuuu

SEQ ID NO: 2582 - RNA, 23 nt, Artificial Sequence
  source: /note="Description of Artificial Sequence: Synthetic oligonucleotide"
uacgucaguucauaaaccuggac

SEQ ID NO: 2583 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaacgtcaguucauaaaccugg

SEQ ID NO: 2584 - RNA, 23 nt, Artificial Sequence
  source: /note="Description of Artificial Sequence: Synthetic oligonucleotide"
uuguaacgucaguucauaaaccu

SEQ ID NO: 2585 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacatuguggucuuggugcug

SEQ ID NO: 2586 - RNA, 23 nt, Artificial Sequence
  source: /note="Description of Artificial Sequence: Synthetic oligonucleotide"
ugcguucugaagagcugcugcaa

SEQ ID NO: 2587 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuataaguuccacaauacuc

SEQ ID NO: 2588 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucgatucagagucauccucca

SEQ ID NO: 2589 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuccgatcucgauucagagucau

SEQ ID NO: 2590 - RNA, 23 nt, Artificial Sequence
  source: /note="Description of Artificial Sequence: Synthetic oligonucleotide"
uacauccgaucucgauucagagu

SEQ ID NO: 2591 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccguctaacacaauuucagaac

SEQ ID NO: 2592 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaccgtcuaacacaauuucaga

SEQ ID NO: 2593 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauactgguugucgguaccguc

SEQ ID NO: 2594 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaauutaucaacacugcuguca

SEQ ID NO: 2595 - RNA, 23 nt, Artificial Sequence
  source: /note="Description of Artificial Sequence: Synthetic oligonucleotide"
ugaggaacuuuauagaguuugcu

SEQ ID NO: 2596 - RNA, 23 nt, Artificial Sequence
  source: /note="Description of Artificial Sequence: Synthetic oligonucleotide"
uugaucgauguaguucaagaugu

SEQ ID NO: 2597 - RNA, 23 nt, Artificial Sequence
  source: /note="Description of Artificial Sequence: Synthetic oligonucleotide"
uaugaucgauguaguucaagaug

SEQ ID NO: 2598 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugatcgauguaguucaagau

SEQ ID NO: 2599 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuccatgaucgauguaguucaa

SEQ ID NO: 2600 - RNA, 23 nt, Artificial Sequence
  source: /note="Description of Artificial Sequence: Synthetic oligonucleotide"
uaaaggaaugcaauccgccaaag

SEQ ID NO: 2601 - RNA, 23 nt, Artificial Sequence
  source: /note="Description of Artificial Sequence: Synthetic oligonucleotide"
ucaguccuaacucacuguagcug

SEQ ID NO: 2602 - RNA, 23 nt, Artificial Sequence
  source: /note="Description of Artificial Sequence: Synthetic oligonucleotide"
uauaggaacuguuccucagaguc

SEQ ID NO: 2603 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugccaataggaacuguuccucag

SEQ ID NO: 2604 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguuatugugcugacggagaaa

SEQ ID NO: 2605 - RNA, 23 nt, Artificial Sequence
  source: /note="Description of Artificial Sequence: Synthetic oligonucleotide"
uugguuauugugcugacggagaa

SEQ ID NO: 2606 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggutauugugcugacggaga

SEQ ID NO: 2607 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguagtagguuauagccucuau

SEQ ID NO: 2608 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuguuatgcuugguaguagguua

SEQ ID NO: 2609 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcucutccuagacucaucugag

SEQ ID NO: 2610 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucggatgggacuuagagaaggg

SEQ ID NO: 2611 - RNA, 23 nt, Artificial Sequence
  source: /note="Description of Artificial Sequence: Synthetic oligonucleotide"
ucaacgguacagaugcuuguucu

SEQ ID NO: 2612 - RNA, 23 nt, Artificial Sequence
  source: /note="Description of Artificial Sequence: Synthetic oligonucleotide"
ugacucaacgguacagaugcuug

SEQ ID NO: 2613 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucagatugucuagaagcugcac

SEQ ID NO: 2614 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuugutguaacaggaccugagg

SEQ ID NO: 2615 - RNA, 23 nt, Artificial Sequence
  source: /note="Description of Artificial Sequence: Synthetic oligonucleotide"
ucagugaugaggauuuacuuguu

SEQ ID NO: 2616 - RNA, 23 nt, Artificial Sequence
  source: /note="Description of Artificial Sequence: Synthetic oligonucleotide"
ucaugcaguuugagguaugaagg

SEQ ID NO: 2617 - RNA, 23 nt, Artificial Sequence
  source: /note="Description of Artificial Sequence: Synthetic oligonucleotide"
ugacaucaugcaguuugagguau

SEQ ID NO: 2618 - RNA, 23 nt, Artificial Sequence
  source: /note="Description of Artificial Sequence: Synthetic oligonucleotide"
uacacacuucccaauguccugca

SEQ ID NO: 2619 - RNA, 23 nt, Artificial Sequence
  source: /note="Description of Artificial Sequence: Synthetic oligonucleotide"
uuucucgacuaaagcaggauuuc

SEQ ID NO: 2620 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautgguucucgacuaaagc

SEQ ID NO: 2621 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaucatugguucucgacuaaag

SEQ ID NO: 2622 - RNA, 23 nt, Artificial Sequence
  source: /note="Description of Artificial Sequence: Synthetic oligonucleotide"
ugaacacaaacaguugccaucau

SEQ ID NO: 2623 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacggtucuuugugacacucgu

SEQ ID NO: 2624 - RNA, 23 nt, Artificial Sequence
  source: /note="Description of Artificial Sequence: Synthetic oligonucleotide"
ugcacgguucuuugugacacucg

SEQ ID NO: 2625 - RNA, 23 nt, Artificial Sequence
  source: /note="Description of Artificial Sequence: Synthetic oligonucleotide"
ugucguguacuguuuuaaagcuu

SEQ ID NO: 2626 - RNA, 23 nt, Artificial Sequence
  source: /note="Description of Artificial Sequence: Synthetic oligonucleotide"
uuaacccguaacugaaccagcug

SEQ ID NO: 2627 - RNA, 23 nt, Artificial Sequence
  source: /note="Description of Artificial Sequence: Synthetic oligonucleotide"
uauuaacccguaacugaaccagc

SEQ ID NO: 2628 - RNA, 23 nt, Artificial Sequence
  source: /note="Description of Artificial Sequence: Synthetic oligonucleotide"
uagacaguaauuaacccguaacu

SEQ ID NO: 2629 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuauctgucgagacagucgcuu

SEQ ID NO: 2630 - RNA, 23 nt, Artificial Sequence
  source: /note="Description of Artificial Sequence: Synthetic oligonucleotide"
ugcuaucugucgagacagucgcu

SEQ ID NO: 2631 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuatcugucgagacagucgc

SEQ ID NO: 2632 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcugutuggcuaacauugggag

SEQ ID NO: 2633 - RNA, 23 nt, Artificial Sequence
  source: /note="Description of Artificial Sequence: Synthetic oligonucleotide"
ugcuucaugagagucaaugugca

SEQ ID NO: 2634 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguauutaacacuccaagggcuu

SEQ ID NO: 2635 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauactccguaaaagcaugucu

SEQ ID NO: 2636 - RNA, 23 nt, Artificial Sequence
  source: /note="Description of Artificial Sequence: Synthetic oligonucleotide"
uuccacaguugaacagugcucac

SEQ ID NO: 2637 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugaatacgagaaagaacaaua

SEQ ID NO: 2638 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaagtauguugcugcucacuc

SEQ ID NO: 2639 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacautccagacuugaagaugu

SEQ ID NO: 2640 - RNA, 23 nt, Artificial Sequence
  source: /note="Description of Artificial Sequence: Synthetic oligonucleotide"
uucggugugguugacaagcagca

SEQ ID NO: 2641 - RNA, 23 nt, Artificial Sequence
  source: /note="Description of Artificial Sequence: Synthetic oligonucleotide"
uagccacguuaagugcucggagu

SEQ ID NO: 2642 - RNA, 23 nt, Artificial Sequence
  source: /note="Description of Artificial Sequence: Synthetic oligonucleotide"
uaugaaguccuguacuggaggcu

SEQ ID NO: 2643 - RNA, 23 nt, Artificial Sequence
  source: /note="Description of Artificial Sequence: Synthetic oligonucleotide"
ugacaagcaaggaugucgaccau

SEQ ID NO: 2644 - RNA, 23 nt, Artificial Sequence
  source: /note="Description of Artificial Sequence: Synthetic oligonucleotide"
ugagagacgaaaccuguccagca

SEQ ID NO: 2645 - RNA, 23 nt, Artificial Sequence
  source: /note="Description of Artificial Sequence: Synthetic oligonucleotide"
uacucacuguuuccagugacacg

SEQ ID NO: 2646 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggactcacuguuuccagugac

SEQ ID NO: 2647 - RNA, 23 nt, Artificial Sequence
  source: /note="Description of Artificial Sequence: Synthetic oligonucleotide"
ucuuagguugaacuccgaguuca

SEQ ID NO: 2648 - RNA, 23 nt, Artificial Sequence
  source: /note="Description of Artificial Sequence: Synthetic oligonucleotide"
ugcuuagguugaacuccgaguuc

SEQ ID NO: 2649 - RNA, 23 nt, Artificial Sequence
  source: /note="Description of Artificial Sequence: Synthetic oligonucleotide"
uggcuuagguugaacuccgaguu

SEQ ID NO: 2650 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucatucaacuugcuccagua

SEQ ID NO: 2651 - RNA, 23 nt, Artificial Sequence
  source: /note="Description of Artificial Sequence: Synthetic oligonucleotide"
ucuggacuaagaagcugcucucc

SEQ ID NO: 2652 - RNA, 23 nt, Artificial Sequence
  source: /note="Description of Artificial Sequence: Synthetic oligonucleotide"
ucguguguagcuguugacaaggg

SEQ ID NO: 2653 - RNA, 23 nt, Artificial Sequence
  source: /note="Description of Artificial Sequence: Synthetic oligonucleotide"
ugguagaugaacuccuuaaagac

SEQ ID NO: 2654 - RNA, 23 nt, Artificial Sequence
  source: /note="Description of Artificial Sequence: Synthetic oligonucleotide"
uaaacugaguacgacugguccag

SEQ ID NO: 2655 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaactgaguacgacuggucca

SEQ ID NO: 2656 - RNA, 23 nt, Artificial Sequence
  source: /note="Description of Artificial Sequence: Synthetic oligonucleotide"
ucagaggauaguucucaaugagg

SEQ ID NO: 2657 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucgtaaacaagucagcagcc

SEQ ID NO: 2658 - RNA, 23 nt, Artificial Sequence
  source: /note="Description of Artificial Sequence: Synthetic oligonucleotide"
uauuucguaaacaagucagcagc

SEQ ID NO: 2659 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacauutcguaaacaagucagca

SEQ ID NO: 2660 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacautucguaaacaagucagc

SEQ ID NO: 2661 - RNA, 23 nt, Artificial Sequence
  source: /note="Description of Artificial Sequence: Synthetic oligonucleotide"
uauguacaacggaaaugucagcg

SEQ ID NO: 2662 - RNA, 23 nt, Artificial Sequence
  source: /note="Description of Artificial Sequence: Synthetic oligonucleotide"
uacaggaacauguacaacggaaa

SEQ ID NO: 2663 - RNA, 21 nt, Artificial Sequence
  source: /note="Description of Artificial Sequence: Synthetic oligonucleotide"
uaccaagaaagaccgugugaa

SEQ ID NO: 2664 - RNA, 21 nt, Artificial Sequence
  source: /note="Description of Artificial Sequence: Synthetic oligonucleotide"
ucaacaaaguuaucaaagcua

SEQ ID NO: 2665 - RNA, 21 nt, Artificial Sequence
  source: /note="Description of Artificial Sequence: Synthetic oligonucleotide"
caacaaaguuaucaaagcuua

SEQ ID NO: 2666 - RNA, 21 nt, Artificial Sequence
  source: /note="Description of Artificial Sequence: Synthetic oligonucleotide"
uugauggauucuaaucuucca

SEQ ID NO: 2667 - RNA, 21 nt, Artificial Sequence
  source: /note="Description of Artificial Sequence: Synthetic oligonucleotide"
auggauucuaaucuuccaaga

SEQ ID NO: 2668 - RNA, 21 nt, Artificial Sequence
  source: /note="Description of Artificial Sequence: Synthetic oligonucleotide"
uucuaaucuuccaagguuaca

SEQ ID NO: 2669 - RNA, 21 nt, Artificial Sequence
  source: /note="Description of Artificial Sequence: Synthetic oligonucleotide"
uguucccaaaauuauggcuua

SEQ ID NO: 2670 - RNA, 21 nt, Artificial Sequence
  source: /note="Description of Artificial Sequence: Synthetic oligonucleotide"
ccagguuuaugaacugacgua

SEQ ID NO: 2671 - RNA, 21 nt, Artificial Sequence
  source: /note="Description of Artificial Sequence: Synthetic oligonucleotide"
guuuaugaacugacguuacaa

SEQ ID NO: 2672 - RNA, 21 nt, Artificial Sequence
  source: /note="Description of Artificial Sequence: Synthetic oligonucleotide"
acugacguuacaucauacaca

SEQ ID NO: 2673 - RNA, 21 nt, Artificial Sequence
  source: /note="Description of Artificial Sequence: Synthetic oligonucleotide"
gcagcagcucuucagaacgca

SEQ ID NO: 2674 - RNA, 21 nt, Artificial Sequence
  source: /note="Description of Artificial Sequence: Synthetic oligonucleotide"
ucugaaucgagaucggaugua

SEQ ID NO: 2675 - RNA, 21 nt, Artificial Sequence
  source: /note="Description of Artificial Sequence: Synthetic oligonucleotide"
cgguaccgacaaccaguauua

SEQ ID NO: 2676 - RNA, 21 nt, Artificial Sequence
  source: /note="Description of Artificial Sequence: Synthetic oligonucleotide"
caaacucuauaaaguuccuca

SEQ ID NO: 2677 - RNA, 21 nt, Artificial Sequence
  source: /note="Description of Artificial Sequence: Synthetic oligonucleotide"
aucuugaacuacaucgaucaa

SEQ ID NO: 2678 - RNA, 21 nt, Artificial Sequence
  source: /note="Description of Artificial Sequence: Synthetic oligonucleotide"
ucuugaacuacaucgaucaua

SEQ ID NO: 2679 - RNA, 21 nt, Artificial Sequence
  source: /note="Description of Artificial Sequence: Synthetic oligonucleotide"
uugaacuacaucgaucaugga

SEQ ID NO: 2680 - RNA, 21 nt, Artificial Sequence
  source: /note="Description of Artificial Sequence: Synthetic oligonucleotide"
uuggcggauugcauuccuuua

SEQ ID NO: 2681 - RNA, 21 nt, Artificial Sequence
  source: /note="Description of Artificial Sequence: Synthetic oligonucleotide"
gcuacagugaguuaggacuga

SEQ ID NO: 2682 - RNA, 21 nt, Artificial Sequence
  source: /note="Description of Artificial Sequence: Synthetic oligonucleotide"
cucugaggaacaguuccuaua

SEQ ID NO: 2683 - RNA, 21 nt, Artificial Sequence
  source: /note="Description of Artificial Sequence: Synthetic oligonucleotide"
gaggaacaguuccuauuggca

SEQ ID NO: 2684 - RNA, 21 nt, Artificial Sequence
  source: /note="Description of Artificial Sequence: Synthetic oligonucleotide"
cuccgucagcacaauaaccaa

SEQ ID NO: 2685 - RNA, 21 nt, Artificial Sequence
  source: /note="Description of Artificial Sequence: Synthetic oligonucleotide"
agaggcuauaaccuacuacca

SEQ ID NO: 2686 - RNA, 21 nt, Artificial Sequence
  source: /note="Description of Artificial Sequence: Synthetic oligonucleotide"
accuacuaccaagcauaacaa

SEQ ID NO: 2687 - RNA, 21 nt, Artificial Sequence
  source: /note="Description of Artificial Sequence: Synthetic oligonucleotide"
cagaugagucuaggaagagca

SEQ ID NO: 2688 - RNA, 21 nt, Artificial Sequence
  source: /note="Description of Artificial Sequence: Synthetic oligonucleotide"
aacaagcaucuguaccguuga

SEQ ID NO: 2689 - RNA, 21 nt, Artificial Sequence
  source: /note="Description of Artificial Sequence: Synthetic oligonucleotide"
agcaucuguaccguugaguca

SEQ ID NO: 2690 - RNA, 21 nt, Artificial Sequence
  source: /note="Description of Artificial Sequence: Synthetic oligonucleotide"
gcagcuucuagacaaucugaa

SEQ ID NO: 2691 - RNA, 21 nt, Artificial Sequence
  source: /note="Description of Artificial Sequence: Synthetic oligonucleotide"
ucuagacaaucugauaccuca

SEQ ID NO: 2692 - RNA, 21 nt, Artificial Sequence
  source: /note="Description of Artificial Sequence: Synthetic oligonucleotide"
ucagguccuguuacaacaaga

SEQ ID NO: 2693 - RNA, 21 nt, Artificial Sequence
  source: /note="Description of Artificial Sequence: Synthetic oligonucleotide"
gguccuguuacaacaaguaaa

SEQ ID NO: 2694 - RNA, 21 nt, Artificial Sequence
  source: /note="Description of Artificial Sequence: Synthetic oligonucleotide"
caaguaaauccucaucacuga

SEQ ID NO: 2695 - RNA, 21 nt, Artificial Sequence
  source: /note="Description of Artificial Sequence: Synthetic oligonucleotide"
uuucuaucaucuuccuucaua

SEQ ID NO: 2696 - RNA, 21 nt, Artificial Sequence
  source: /note="Description of Artificial Sequence: Synthetic oligonucleotide"
uucauaccucaaacugcauga

SEQ ID NO: 2697 - RNA, 21 nt, Artificial Sequence
  source: /note="Description of Artificial Sequence: Synthetic oligonucleotide"
accucaaacugcaugauguca

SEQ ID NO: 2698 - RNA, 21 nt, Artificial Sequence
  source: /note="Description of Artificial Sequence: Synthetic oligonucleotide"
caggacauugggaagugugua

SEQ ID NO: 2699 - RNA, 21 nt, Artificial Sequence
  source: /note="Description of Artificial Sequence: Synthetic oligonucleotide"
aauccugcuuuagucgagaaa

SEQ ID NO: 2700 - RNA, 21 nt, Artificial Sequence
  source: /note="Description of Artificial Sequence: Synthetic oligonucleotide"
gauggcaacuguuuguguuca

SEQ ID NO: 2701 - RNA, 21 nt, Artificial Sequence
  source: /note="Description of Artificial Sequence: Synthetic oligonucleotide"
agugucacaaagaaccgugca

SEQ ID NO: 2702 - RNA, 21 nt, Artificial Sequence
  source: /note="Description of Artificial Sequence: Synthetic oligonucleotide"
ugcagauaagaaugcuauuca

SEQ ID NO: 2703 - RNA, 21 nt, Artificial Sequence
  source: /note="Description of Artificial Sequence: Synthetic oligonucleotide"
gcuuuaaaacaguacacgaca

SEQ ID NO: 2704 - RNA, 21 nt, Artificial Sequence
  source: /note="Description of Artificial Sequence: Synthetic oligonucleotide"
gcugguucaguuacggguuaa

SEQ ID NO: 2705 - RNA, 21 nt, Artificial Sequence
  source: /note="Description of Artificial Sequence: Synthetic oligonucleotide"
ugguucaguuacggguuaaua

SEQ ID NO: 2706 - RNA, 21 nt, Artificial Sequence
  source: /note="Description of Artificial Sequence: Synthetic oligonucleotide"
uuacggguuaauuacugucua

SEQ ID NO: 2707 - RNA, 21 nt, Artificial Sequence
  source: /note="Description of Artificial Sequence: Synthetic oligonucleotide"
uggauucagaucagguguuua

SEQ ID NO: 2708 - RNA, 21 nt, Artificial Sequence
  source: /note="Description of Artificial Sequence: Synthetic oligonucleotide"
uaugaacgcuaucauucaaaa

SEQ ID NO: 2709 - RNA, 21 nt, Artificial Sequence
  source: /note="Description of Artificial Sequence: Synthetic oligonucleotide"
gcgacugucucgacagauaga

SEQ ID NO: 2710 - RNA, 21 nt, Artificial Sequence
  source: /note="Description of Artificial Sequence: Synthetic oligonucleotide"
cgacugucucgacagauagca

SEQ ID NO: 2711 - RNA, 21 nt, Artificial Sequence
  source: /note="Description of Artificial Sequence: Synthetic oligonucleotide"
cccaauguuagccaaacagca

SEQ ID NO: 2712 - RNA, 21 nt, Artificial Sequence
  source: /note="Description of Artificial Sequence: Synthetic oligonucleotide"
cacauugacucucaugaagca

SEQ ID NO: 2713 - RNA, 21 nt, Artificial Sequence
  source: /note="Description of Artificial Sequence: Synthetic oligonucleotide"
gagcacuguucaacuguggaa

SEQ ID NO: 2714 - RNA, 21 nt, Artificial Sequence
  source: /note="Description of Artificial Sequence: Synthetic oligonucleotide"
gugagcagcaacauacuuuca

SEQ ID NO: 2715 - RNA, 21 nt, Artificial Sequence
  source: /note="Description of Artificial Sequence: Synthetic oligonucleotide"
cugcuugucaaccacaccgaa

SEQ ID NO: 2716 - RNA, 21 nt, Artificial Sequence
  source: /note="Description of Artificial Sequence: Synthetic oligonucleotide"
uccgagcacuuaacguggcua

SEQ ID NO: 2717 - RNA, 21 nt, Artificial Sequence
  source: /note="Description of Artificial Sequence: Synthetic oligonucleotide"
ccuccaguacaggacuucaua

SEQ ID NO: 2718 - RNA, 21 nt, Artificial Sequence
  source: /note="Description of Artificial Sequence: Synthetic oligonucleotide"
caauucagucucguugugaaa

SEQ ID NO: 2719 - RNA, 21 nt, Artificial Sequence
  source: /note="Description of Artificial Sequence: Synthetic oligonucleotide"
ggucgacauccuugcuuguca

SEQ ID NO: 2720 - RNA, 21 nt, Artificial Sequence
  source: /note="Description of Artificial Sequence: Synthetic oligonucleotide"
cuggacagguuucgucucuca

SEQ ID NO: 2721 - RNA, 21 nt, Artificial Sequence
  source: /note="Description of Artificial Sequence: Synthetic oligonucleotide"
ugucacuggaaacagugagua

SEQ ID NO: 2722 - RNA, 21 nt, Artificial Sequence
  source: /note="Description of Artificial Sequence: Synthetic oligonucleotide"
aacucggaguucaaccuaaga

SEQ ID NO: 2723 - RNA, 21 nt, Artificial Sequence
  source: /note="Description of Artificial Sequence: Synthetic oligonucleotide"
acucggaguucaaccuaagca

SEQ ID NO: 2724 - RNA, 21 nt, Artificial Sequence
  source: /note="Description of Artificial Sequence: Synthetic oligonucleotide"
cucggaguucaaccuaagcca

SEQ ID NO: 2725 - RNA, 21 nt, Artificial Sequence
  source: /note="Description of Artificial Sequence: Synthetic oligonucleotide"
cuggagcaaguugaaugauca

SEQ ID NO: 2726 - RNA, 21 nt, Artificial Sequence
  source: /note="Description of Artificial Sequence: Synthetic oligonucleotide"
agagcagcuucuuaguccaga

SEQ ID NO: 2727 - RNA, 21 nt, Artificial Sequence
  source: /note="Description of Artificial Sequence: Synthetic oligonucleotide"
cuugucaacagcuacacacga

SEQ ID NO: 2728 - RNA, 21 nt, Artificial Sequence
  source: /note="Description of Artificial Sequence: Synthetic oligonucleotide"
cuuuaaggaguucaucuacca

SEQ ID NO: 2729 - RNA, 21 nt, Artificial Sequence
  source: /note="Description of Artificial Sequence: Synthetic oligonucleotide"
ggaccagucguacucaguuua

SEQ ID NO: 2730 - RNA, 21 nt, Artificial Sequence
  source: /note="Description of Artificial Sequence: Synthetic oligonucleotide"
ucauugagaacuauccucuga

SEQ ID NO: 2731 - RNA, 21 nt, Artificial Sequence
  source: /note="Description of Artificial Sequence: Synthetic oligonucleotide"
ugcugacuuguuuacgaaaua

SEQ ID NO: 2732 - RNA, 21 nt, Artificial Sequence
  source: /note="Description of Artificial Sequence: Synthetic oligonucleotide"
cugacauuuccguuguacaua

SEQ ID NO: 2733 - RNA, 21 nt, Artificial Sequence
  source: /note="Description of Artificial Sequence: Synthetic oligonucleotide"
uccguuguacauguuccugua

SEQ ID NO: 2734 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacggtcuuucuugguagcuga

SEQ ID NO: 2735 - RNA, 23 nt, Artificial Sequence
  source: /note="Description of Artificial Sequence: Synthetic oligonucleotide"
ucacacggucuuucuugguagcu

SEQ ID NO: 2736 - RNA, 23 nt, Artificial Sequence
  source: /note="Description of Artificial Sequence: Synthetic oligonucleotide"
uucacacggucuuucuugguagc

SEQ ID NO: 2737 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucacatauugucagacaaugau

SEQ ID NO: 2738 - RNA, 23 nt, Artificial Sequence
  source: /note="Description of Artificial Sequence: Synthetic oligonucleotide"
ugauaacuuuguugaggcauucg

SEQ ID NO: 2739 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuutgauaacuuuguugagg

SEQ ID NO: 2740 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaagcutugauaacuuuguugag

SEQ ID NO: 2741 - RNA, 23 nt, Artificial Sequence
  source: /note="Description of Artificial Sequence: Synthetic oligonucleotide"
uagauuagaauccaucaaagcuu

SEQ ID NO: 2742 - RNA, 23 nt, Artificial Sequence
  source: /note="Description of Artificial Sequence: Synthetic oligonucleotide"
uggaagauuagaauccaucaaag

SEQ ID NO: 2743 - RNA, 23 nt, Artificial Sequence
  source: /note="Description of Artificial Sequence: Synthetic oligonucleotide"
ucuuggaagauuagaauccauca

SEQ ID NO: 2744 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccutggaagauuagaaucca

SEQ ID NO: 2745 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaacctuggaagauuagaaucc

SEQ ID NO: 2746 - RNA, 23 nt, Artificial Sequence
  source: /note="Description of Artificial Sequence: Synthetic oligonucleotide"
uguaaccuuggaagauuagaauc

SEQ ID NO: 2747 - RNA, 23 nt, Artificial Sequence
  source: /note="Description of Artificial Sequence: Synthetic oligonucleotide"
ucucgagcuguaaccuuggaaga

SEQ ID NO: 2748 - RNA, 23 nt, Artificial Sequence
  source: /note="Description of Artificial Sequence: Synthetic oligonucleotide"
uaagccauaauuuugggaacagc

SEQ ID NO: 2749 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggutcgcuaugaaggccuuu

SEQ ID NO: 2750 - RNA, 23 nt, Artificial Sequence
  source: /note="Description of Artificial Sequence: Synthetic oligonucleotide"
uacgucaguucauaaaccuggac

SEQ ID NO: 2751 - RNA, 23 nt, Artificial Sequence
  source: /note="Description of Artificial Sequence: Synthetic oligonucleotide"
uaacgucaguucauaaaccugga

SEQ ID NO: 2752 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaacgtcaguucauaaaccugg

SEQ ID NO: 2753 - RNA, 23 nt, Artificial Sequence
  source: /note="Description of Artificial Sequence: Synthetic oligonucleotide"
uuguaacgucaguucauaaaccu

SEQ ID NO: 2754 - RNA, 23 nt, Artificial Sequence
  source: /note="Description of Artificial Sequence: Synthetic oligonucleotide"
uauguaacgucaguucauaaacc

SEQ ID NO: 2755 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguguatgauguaacgucaguuc

SEQ ID NO: 2756 - RNA, 23 nt, Artificial Sequence
  source: /note="Description of Artificial Sequence: Synthetic oligonucleotide"
uacauuguggucuuggugcugug

SEQ ID NO: 2757 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacatuguggucuuggugcug

SEQ ID NO: 2758 - RNA, 23 nt, Artificial Sequence
  source: /note="Description of Artificial Sequence: Synthetic oligonucleotide"
ugcguucugaagagcugcugcaa

SEQ ID NO: 2759 - RNA, 23 nt, Artificial Sequence
  source: /note="Description of Artificial Sequence: Synthetic oligonucleotide"
ucuauaaguuccacaauacuccc

SEQ ID NO: 2760 - RNA, 23 nt, Artificial Sequence
  source: /note="Description of Artificial Sequence: Synthetic oligonucleotide"
ugcuauaaguuccacaauacucc

SEQ ID NO: 2761 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuataaguuccacaauacuc

SEQ ID NO: 2762 - RNA, 23 nt, Artificial Sequence
  source: /note="Description of Artificial Sequence: Synthetic oligonucleotide"
ucgauucagagucauccuccaag

SEQ ID NO: 2763 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucgatucagagucauccucca

SEQ ID NO: 2764 - RNA, 23 nt, Artificial Sequence
  source: /note="Description of Artificial Sequence: Synthetic oligonucleotide"
uucucgauucagagucauccucc

SEQ ID NO: 2765 - RNA, 23 nt, Artificial Sequence
  source: /note="Description of Artificial Sequence: Synthetic oligonucleotide"
uaucucgauucagagucauccuc

SEQ ID NO: 2766 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuccgatcucgauucagagucau

SEQ ID NO: 2767 - RNA, 23 nt, Artificial Sequence
  source: /note="Description of Artificial Sequence: Synthetic oligonucleotide"
uauccgaucucgauucagaguca

SEQ ID NO: 2768 - RNA, 23 nt, Artificial Sequence
  source: /note="Description of Artificial Sequence: Synthetic oligonucleotide"
ucauccgaucucgauucagaguc

SEQ ID NO: 2769 - RNA, 23 nt, Artificial Sequence
  source: /note="Description of Artificial Sequence: Synthetic oligonucleotide"
uacauccgaucucgauucagagu

SEQ ID NO: 2770 - RNA, 23 nt, Artificial Sequence
  source: /note="Description of Artificial Sequence: Synthetic oligonucleotide"
ucgucuaacacaauuucagaacu

SEQ ID NO: 2771 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccguctaacacaauuucagaac

SEQ ID NO: 2772 - RNA, 23 nt, Artificial Sequence
  source: /note="Description of Artificial Sequence: Synthetic oligonucleotide"
uaccgucuaacacaauuucagaa

SEQ ID NO: 2773 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaccgtcuaacacaauuucaga

SEQ ID NO: 2774 - RNA, 23 nt, Artificial Sequence
  source: /note="Description of Artificial Sequence: Synthetic oligonucleotide"
uguaccgucuaacacaauuucag

SEQ ID NO: 2775 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaauactgguugucgguaccguc

SEQ ID NO: 2776 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaauutaucaacacugcuguca

SEQ ID NO: 2777 - RNA, 23 nt, Artificial Sequence
  source: /note="Description of Artificial Sequence: Synthetic oligonucleotide"
ucggacacaauggacaagaggug

SEQ ID NO: 2778 - RNA, 23 nt, Artificial Sequence
  source: /note="Description of Artificial Sequence: Synthetic oligonucleotide"
ucgaagcagauaaaaggcggaca

SEQ ID NO: 2779 - RNA, 23 nt, Artificial Sequence
  source: /note="Description of Artificial Sequence: Synthetic oligonucleotide"
uacgaagcagauaaaaggcggac

SEQ ID NO: 2780 - RNA, 23 nt, Artificial Sequence
  source: /note="Description of Artificial Sequence: Synthetic oligonucleotide"
uaacgaagcagauaaaaggcgga

SEQ ID NO: 2781 - RNA, 23 nt, Artificial Sequence
  source: /note="Description of Artificial Sequence: Synthetic oligonucleotide"
ugaggaacuuuauagaguuugcu

SEQ ID NO: 2782 - RNA, 23 nt, Artificial Sequence
  source: /note="Description of Artificial Sequence: Synthetic oligonucleotide"
ugucaagaggaacuuuauagagu

SEQ ID NO: 2783 - RNA, 23 nt, Artificial Sequence
  source: /note="Description of Artificial Sequence: Synthetic oligonucleotide"
ugaucgauguaguucaagauguc

SEQ ID NO: 2784 - RNA, 23 nt, Artificial Sequence
  source: /note="Description of Artificial Sequence: Synthetic oligonucleotide"
uugaucgauguaguucaagaugu

SEQ ID NO: 2785 - RNA, 23 nt, Artificial Sequence
  source: /note="Description of Artificial Sequence: Synthetic oligonucleotide"
uaugaucgauguaguucaagaug

SEQ ID NO: 2786 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugatcgauguaguucaagau

SEQ ID NO: 2787 - RNA, 23 nt, Artificial Sequence
  source: /note="Description of Artificial Sequence: Synthetic oligonucleotide"
uccaugaucgauguaguucaaga

SEQ ID NO: 2788 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuccatgaucgauguaguucaa

SEQ ID NO: 2789 - RNA, 23 nt, Artificial Sequence
  source: /note="Description of Artificial Sequence: Synthetic oligonucleotide"
uaaggaaugcaauccgccaaaga

SEQ ID NO: 2790 - RNA, 23 nt, Artificial Sequence
  source: /note="Description of Artificial Sequence: Synthetic oligonucleotide"
uaaaggaaugcaauccgccaaag

SEQ ID NO: 2791 - RNA, 23 nt, Artificial Sequence
  source: /note="Description of Artificial Sequence: Synthetic oligonucleotide"
ucaguccuaacucacuguagcug

SEQ ID NO: 2792 - RNA, 23 nt, Artificial Sequence
  source: /note="Description of Artificial Sequence: Synthetic oligonucleotide"
uauaggaacuguuccucagaguc

SEQ ID NO: 2793 - RNA, 23 nt, Artificial Sequence
  source: /note="Description of Artificial Sequence: Synthetic oligonucleotide"
ucaauaggaacuguuccucagag

SEQ ID NO: 2794 - RNA, 23 nt, Artificial Sequence
  source: /note="Description of Artificial Sequence: Synthetic oligonucleotide"
uccaauaggaacuguuccucaga

SEQ ID NO: 2795 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugccaataggaacuguuccucag

SEQ ID NO: 2796 - RNA, 23 nt, Artificial Sequence
  source: /note="Description of Artificial Sequence: Synthetic oligonucleotide"
ugacaacauuauugagcacucgu

SEQ ID NO: 2797 - RNA, 23 nt, Artificial Sequence
  source: /note="Description of Artificial Sequence: Synthetic oligonucleotide"
ucggagaaaugagauggaggcug

SEQ ID NO: 2798 - RNA, 23 nt, Artificial Sequence
  source: /note="Description of Artificial Sequence: Synthetic oligonucleotide"
uacggagaaaugagauggaggcu

SEQ ID NO: 2799 - RNA, 23 nt, Artificial Sequence
  source: /note="Description of Artificial Sequence: Synthetic oligonucleotide"
ugacggagaaaugagauggaggc

SEQ ID NO: 2800 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguuatugugcugacggagaaa

SEQ ID NO: 2801 - RNA, 23 nt, Artificial Sequence
  source: /note="Description of Artificial Sequence: Synthetic oligonucleotide"
uugguuauugugcugacggagaa

SEQ ID NO: 2802 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggutauugugcugacggaga

SEQ ID NO: 2803 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugguagtagguuauagccucuau

SEQ ID NO: 2804 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuguuatgcuugguaguagguua

SEQ ID NO: 2805 - RNA, 23 nt, Artificial Sequence
  source: /note="Description of Artificial Sequence: Synthetic oligonucleotide"
ugcaauaacucuugaaagguuau

SEQ ID NO: 2806 - RNA, 23 nt, Artificial Sequence
  source: /note="Description of Artificial Sequence: Synthetic oligonucleotide"
ucuaaacuccaaaugcaaacugg

SEQ ID NO: 2807 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcucutccuagacucaucugag

SEQ ID NO: 2808 - RNA, 23 nt, Artificial Sequence
  source: /note="Description of Artificial Sequence: Synthetic oligonucleotide"
ucgguacagcucuuccuagacuc

SEQ ID NO: 2809 - RNA, 23 nt, Artificial Sequence
  source: /note="Description of Artificial Sequence: Synthetic oligonucleotide"
ucaacgguacagcucuuccuaga

SEQ ID NO: 2810 - RNA, 23 nt, Artificial Sequence
  source: /note="Description of Artificial Sequence: Synthetic oligonucleotide"
uccaaugggaaccaagcugacga

SEQ ID NO: 2811 - RNA, 23 nt, Artificial Sequence
  source: /note="Description of Artificial Sequence: Synthetic oligonucleotide"
ucugcaagcaaguuuccggccaa

SEQ ID NO: 2812 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucggatgggacuuagagaaggg

SEQ ID NO: 2813 - RNA, 23 nt, Artificial Sequence
  source: /note="Description of Artificial Sequence: Synthetic oligonucleotide"
ucgguacagaugcuuguucuccu

SEQ ID NO: 2814 - RNA, 23 nt, Artificial Sequence
  source: /note="Description of Artificial Sequence: Synthetic oligonucleotide"
ucaacgguacagaugcuuguucu

SEQ ID NO: 2815 - RNA, 23 nt, Artificial Sequence
  source: /note="Description of Artificial Sequence: Synthetic oligonucleotide"
ugacucaacgguacagaugcuug

SEQ ID NO: 2816 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucagatugucuagaagcugcac

SEQ ID NO: 2817 - RNA, 23 nt, Artificial Sequence
  source: /note="Description of Artificial Sequence: Synthetic oligonucleotide"
ugagguaucagauugucuagaag

SEQ ID NO: 2818 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuugutguaacaggaccugagg

SEQ ID NO: 2819 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuacutguuguaacaggaccug

SEQ ID NO: 2820 - RNA, 23 nt, Artificial Sequence
  source: /note="Description of Artificial Sequence: Synthetic oligonucleotide"
ucagugaugaggauuuacuuguu

SEQ ID NO: 2821 - RNA, 23 nt, Artificial Sequence
  source: /note="Description of Artificial Sequence: Synthetic oligonucleotide"
uaugaaggaagaugauagaaacu

SEQ ID NO: 2822 - RNA, 23 nt, Artificial Sequence
  source: /note="Description of Artificial Sequence: Synthetic oligonucleotide"
ucaugcaguuugagguaugaagg

SEQ ID NO: 2823 - RNA, 23 nt, Artificial Sequence
  source: /note="Description of Artificial Sequence: Synthetic oligonucleotide"
ugacaucaugcaguuugagguau

SEQ ID NO: 2824 - RNA, 23 nt, Artificial Sequence
  source: /note="Description of Artificial Sequence: Synthetic oligonucleotide"
uacacacuucccaauguccugca

SEQ ID NO: 2825 - RNA, 23 nt, Artificial Sequence
  source: /note="Description of Artificial Sequence: Synthetic oligonucleotide"
ugacuaaagcaggauuucaggua

SEQ ID NO: 2826 - RNA, 23 nt, Artificial Sequence
  source: /note="Description of Artificial Sequence: Synthetic oligonucleotide"
ucgacuaaagcaggauuucaggu

SEQ ID NO: 2827 - RNA, 23 nt, Artificial Sequence
  source: /note="Description of Artificial Sequence: Synthetic oligonucleotide"
ucucgacuaaagcaggauuucag

SEQ ID NO: 2828 - RNA, 23 nt, Artificial Sequence
  source: /note="Description of Artificial Sequence: Synthetic oligonucleotide"
uuucucgacuaaagcaggauuuc

SEQ ID NO: 2829 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautgguucucgacuaaagc

SEQ ID NO: 2830 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaucatugguucucgacuaaag

SEQ ID NO: 2831 - RNA, 23 nt, Artificial Sequence
  source: /note="Description of Artificial Sequence: Synthetic oligonucleotide"
ugaacacaaacaguugccaucau

SEQ ID NO: 2832 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacggtucuuugugacacucgu

SEQ ID NO: 2833 - RNA, 23 nt, Artificial Sequence
  source: /note="Description of Artificial Sequence: Synthetic oligonucleotide"
ugcacgguucuuugugacacucg

SEQ ID NO: 2834 - RNA, 23 nt, Artificial Sequence
  source: /note="Description of Artificial Sequence: Synthetic oligonucleotide"
ugaauagcauucuuaucugcacg

SEQ ID NO: 2835 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugautaugaauagcauucuua

SEQ ID NO: 2836 - RNA, 23 nt, Artificial Sequence
  source: /note="Description of Artificial Sequence: Synthetic oligonucleotide"
ucgaaugugauuaugaauagcau

SEQ ID NO: 2837 - RNA, 23 nt, Artificial Sequence
  source: /note="Description of Artificial Sequence: Synthetic oligonucleotide"
uuucaaacaaacgaaugugauua

SEQ ID NO: 2838 - RNA, 23 nt, Artificial Sequence
  source: /note="Description of Artificial Sequence: Synthetic oligonucleotide"
uuauaacaagagguucaaacaaa

SEQ ID NO: 2839 - RNA, 23 nt, Artificial Sequence
  source: /note="Description of Artificial Sequence: Synthetic oligonucleotide"
uuuauaacaagagguucaaacaa

SEQ ID NO: 2840 - RNA, 23 nt, Artificial Sequence
  source: /note="Description of Artificial Sequence: Synthetic oligonucleotide"
uuuuauaacaagagguucaaaca

SEQ ID NO: 2841 - RNA, 23 nt, Artificial Sequence
  source: /note="Description of Artificial Sequence: Synthetic oligonucleotide"
ugucguguacuguuuuaaagcuu

SEQ ID NO: 2842 - RNA, 23 nt, Artificial Sequence
  source: /note="Description of Artificial Sequence: Synthetic oligonucleotide"
uaacccguaacugaaccagcugc

SEQ ID NO: 2843 - RNA, 23 nt, Artificial Sequence
  source: /note="Description of Artificial Sequence: Synthetic oligonucleotide"
uuaacccguaacugaaccagcug

SEQ ID NO: 2844 - RNA, 23 nt, Artificial Sequence
  source: /note="Description of Artificial Sequence: Synthetic oligonucleotide"
uauuaacccguaacugaaccagc

SEQ ID NO: 2845 - RNA, 23 nt, Artificial Sequence
  source: /note="Description of Artificial Sequence: Synthetic oligonucleotide"
uuaauuaacccguaacugaacca

SEQ ID NO: 2846 - RNA, 23 nt, Artificial Sequence
  source: /note="Description of Artificial Sequence: Synthetic oligonucleotide"
ucaguaauuaacccguaacugaa

SEQ ID NO: 2847 - RNA, 23 nt, Artificial Sequence
  source: /note="Description of Artificial Sequence: Synthetic oligonucleotide"
uagacaguaauuaacccguaacu

SEQ ID NO: 2848 - RNA, 23 nt, Artificial Sequence
  source: /note="Description of Artificial Sequence: Synthetic oligonucleotide"
uaaacaccugaucugaauccaga

SEQ ID NO: 2849 - RNA, 23 nt, Artificial Sequence
  source: /note="Description of Artificial Sequence: Synthetic oligonucleotide"
uuuugaaugauagcguucauaag

SEQ ID NO: 2850 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuauctgucgagacagucgcuu

SEQ ID NO: 2851 - RNA, 23 nt, Artificial Sequence
  source: /note="Description of Artificial Sequence: Synthetic oligonucleotide"
ugcuaucugucgagacagucgcu

SEQ ID NO: 2852 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuatcugucgagacagucgc

SEQ ID NO: 2853 - RNA, 23 nt, Artificial Sequence
  source: /note="Description of Artificial Sequence: Synthetic oligonucleotide"
ucagcuaucugucgagacagucg

SEQ ID NO: 2854 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcugutuggcuaacauugggag

SEQ ID NO: 2855 - RNA, 23 nt, Artificial Sequence
  source: /note="Description of Artificial Sequence: Synthetic oligonucleotide"
ugcuucaugagagucaaugugca

SEQ ID NO: 2856 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguauutaacacuccaagggcuu

SEQ ID NO: 2857 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauactccguaaaagcaugucu

SEQ ID NO: 2858 - RNA, 23 nt, Artificial Sequence
  source: /note="Description of Artificial Sequence: Synthetic oligonucleotide"
ugacgaacauacuccguaaaagc

SEQ ID NO: 2859 - RNA, 23 nt, Artificial Sequence
  source: /note="Description of Artificial Sequence: Synthetic oligonucleotide"
uugacgaacauacuccguaaaag

SEQ ID NO: 2860 - RNA, 23 nt, Artificial Sequence
  source: /note="Description of Artificial Sequence: Synthetic oligonucleotide"
uuccacaguugaacagugcucac

SEQ ID NO: 2861 - RNA, 23 nt, Artificial Sequence
  source: /note="Description of Artificial Sequence: Synthetic oligonucleotide"
uacgagaaagaacaauaucuuca

SEQ ID NO: 2862 - RNA, 23 nt, Artificial Sequence
  source: /note="Description of Artificial Sequence: Synthetic oligonucleotide"
uauacgagaaagaacaauaucuu

SEQ ID NO: 2863 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugaatacgagaaagaacaaua

SEQ ID NO: 2864 - RNA, 23 nt, Artificial Sequence
  source: /note="Description of Artificial Sequence: Synthetic oligonucleotide"
uccugaauacgagaaagaacaau

SEQ ID NO: 2865 - RNA, 23 nt, Artificial Sequence
  source: /note="Description of Artificial Sequence: Synthetic oligonucleotide"
uguaauagaaaccuugaaaaugu

SEQ ID NO: 2866 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaaagtauguugcugcucacuc

SEQ ID NO: 2867 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcaatagaaaguauguugcug

SEQ ID NO: 2868 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacautccagacuugaagaugu

SEQ ID NO: 2869 - RNA, 23 nt, Artificial Sequence
  source: /note="Description of Artificial Sequence: Synthetic oligonucleotide"
uucggugugguugacaagcagca

SEQ ID NO: 2870 - RNA, 23 nt, Artificial Sequence
  source: /note="Description of Artificial Sequence: Synthetic oligonucleotide"
uagccacguuaagugcucggagu

SEQ ID NO: 2871 - RNA, 23 nt, Artificial Sequence
  source: /note="Description of Artificial Sequence: Synthetic oligonucleotide"
uaugaaguccuguacuggaggcu

SEQ ID NO: 2872 - RNA, 23 nt, Artificial Sequence
  source: /note="Description of Artificial Sequence: Synthetic oligonucleotide"
ucaacgagacugaauugccugga

SEQ ID NO: 2873 - RNA, 23 nt, Artificial Sequence
  source: /note="Description of Artificial Sequence: Synthetic oligonucleotide"
uacaacgagacugaauugccugg

SEQ ID NO: 2874 - RNA, 23 nt, Artificial Sequence
  source: /note="Description of Artificial Sequence: Synthetic oligonucleotide"
ucacaacgagacugaauugccug

SEQ ID NO: 2875 - RNA, 23 nt, Artificial Sequence
  source: /note="Description of Artificial Sequence: Synthetic oligonucleotide"
uucacaacgagacugaauugccu

SEQ ID NO: 2876 - RNA, 23 nt, Artificial Sequence
  source: /note="Description of Artificial Sequence: Synthetic oligonucleotide"
uuucacaacgagacugaauugcc

SEQ ID NO: 2877 - RNA, 23 nt, Artificial Sequence
  source: /note="Description of Artificial Sequence: Synthetic oligonucleotide"
ucaagcaaggaugucgaccaugc

SEQ ID NO: 2878 - RNA, 23 nt, Artificial Sequence
  source: /note="Description of Artificial Sequence: Synthetic oligonucleotide"
ugacaagcaaggaugucgaccau

SEQ ID NO: 2879 - RNA, 23 nt, Artificial Sequence
  source: /note="Description of Artificial Sequence: Synthetic oligonucleotide"
ucgacaagcaaggaugucgacca

SEQ ID NO: 2880 - RNA, 23 nt, Artificial Sequence
  source: /note="Description of Artificial Sequence: Synthetic oligonucleotide"
ugagagacgaaaccuguccagca

SEQ ID NO: 2881 - RNA, 23 nt, Artificial Sequence
  source: /note="Description of Artificial Sequence: Synthetic oligonucleotide"
ugacuaagugagucuugcauggu

SEQ ID NO: 2882 - RNA, 23 nt, Artificial Sequence
  source: /note="Description of Artificial Sequence: Synthetic oligonucleotide"
uggacuaagugagucuugcaugg

SEQ ID NO: 2883 - RNA, 23 nt, Artificial Sequence
  source: /note="Description of Artificial Sequence: Synthetic oligonucleotide"
uacucacuguuuccagugacacg

SEQ ID NO: 2884 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggactcacuguuuccagugac

SEQ ID NO: 2885 - RNA, 23 nt, Artificial Sequence
  source: /note="Description of Artificial Sequence: Synthetic oligonucleotide"
ucaggaauccgauucaccagcuc

SEQ ID NO: 2886 - RNA, 23 nt, Artificial Sequence
  source: /note="Description of Artificial Sequence: Synthetic oligonucleotide"
ucuuagguugaacuccgaguuca

SEQ ID NO: 2887 - RNA, 23 nt, Artificial Sequence
  source: /note="Description of Artificial Sequence: Synthetic oligonucleotide"
ugcuuagguugaacuccgaguuc

SEQ ID NO: 2888 - RNA, 23 nt, Artificial Sequence
  source: /note="Description of Artificial Sequence: Synthetic oligonucleotide"
uggcuuagguugaacuccgaguu

SEQ ID NO: 2889 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucatucaacuugcuccagua

SEQ ID NO: 2890 - RNA, 23 nt, Artificial Sequence
  source: /note="Description of Artificial Sequence: Synthetic oligonucleotide"
ucuggacuaagaagcugcucucc

SEQ ID NO: 2891 - RNA, 23 nt, Artificial Sequence
  source: /note="Description of Artificial Sequence: Synthetic oligonucleotide"
ucguguguagcuguugacaaggg

SEQ ID NO: 2892 - RNA, 23 nt, Artificial Sequence
  source: /note="Description of Artificial Sequence: Synthetic oligonucleotide"
ucacacguguguagcuguugaca

SEQ ID NO: 2893 - RNA, 23 nt, Artificial Sequence
  source: /note="Description of Artificial Sequence: Synthetic oligonucleotide"
ugcacacguguguagcuguugac

SEQ ID NO: 2894 - RNA, 23 nt, Artificial Sequence
  source: /note="Description of Artificial Sequence: Synthetic oligonucleotide"
ugguagaugaacuccuuaaagac

SEQ ID NO: 2895 - RNA, 23 nt, Artificial Sequence
  source: /note="Description of Artificial Sequence: Synthetic oligonucleotide"
uaaacugaguacgacugguccag

SEQ ID NO: 2896 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaactgaguacgacuggucca

SEQ ID NO: 2897 - RNA, 23 nt, Artificial Sequence
  source: /note="Description of Artificial Sequence: Synthetic oligonucleotide"
uucaaacugaguacgacuggucc

SEQ ID NO: 2898 - RNA, 23 nt, Artificial Sequence
  source: /note="Description of Artificial Sequence: Synthetic oligonucleotide"
uuucaaacugaguacgacugguc

SEQ ID NO: 2899 - RNA, 23 nt, Artificial Sequence
  source: /note="Description of Artificial Sequence: Synthetic oligonucleotide"
ucuucaaacugaguacgacuggu

SEQ ID NO: 2900 - RNA, 23 nt, Artificial Sequence
  source: /note="Description of Artificial Sequence: Synthetic oligonucleotide"
uuucgcaguucugucagcgucac

SEQ ID NO: 2901 - RNA, 23 nt, Artificial Sequence
  source: /note="Description of Artificial Sequence: Synthetic oligonucleotide"
ucuucgcaguucugucagcguca

SEQ ID NO: 2902 - RNA, 23 nt, Artificial Sequence
  source: /note="Description of Artificial Sequence: Synthetic oligonucleotide"
ucagaggauaguucucaaugagg

SEQ ID NO: 2903 - RNA, 23 nt, Artificial Sequence
  source: /note="Description of Artificial Sequence: Synthetic oligonucleotide"
ucguaaacaagucagcagccggu

SEQ ID NO: 2904 - RNA, 23 nt, Artificial Sequence
  source: /note="Description of Artificial Sequence: Synthetic oligonucleotide"
uucguaaacaagucagcagccgg

SEQ ID NO: 2905 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuucgtaaacaagucagcagcc

SEQ ID NO: 2906 - RNA, 23 nt, Artificial Sequence
  source: /note="Description of Artificial Sequence: Synthetic oligonucleotide"
uauuucguaaacaagucagcagc

SEQ ID NO: 2907 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacauutcguaaacaagucagca

SEQ ID NO: 2908 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacautucguaaacaagucagc

SEQ ID NO: 2909 - RNA, 23 nt, Artificial Sequence
  source: /note="Description of Artificial Sequence: Synthetic oligonucleotide"
ugcauagaaagaguuacguuaaa

SEQ ID NO: 2910 - RNA, 23 nt, Artificial Sequence
  source: /note="Description of Artificial Sequence: Synthetic oligonucleotide"
uuacaacggaaaugucagcgggu

SEQ ID NO: 2911 - RNA, 23 nt, Artificial Sequence
  source: /note="Description of Artificial Sequence: Synthetic oligonucleotide"
uauguacaacggaaaugucagcg

SEQ ID NO: 2912 - RNA, 23 nt, Artificial Sequence
  source: /note="Description of Artificial Sequence: Synthetic oligonucleotide"
uacaggaacauguacaacggaaa

SEQ ID NO: 2913 - RNA, 23 nt, Artificial Sequence
  source: /note="Description of Artificial Sequence: Synthetic oligonucleotide"
gcuaccaagaaagaccgugugaa

SEQ ID NO: 2914 - RNA, 23 nt, Artificial Sequence
  source: /note="Description of Artificial Sequence: Synthetic oligonucleotide"
agguuuaugaacugacguuacau

SEQ ID NO: 2915 - RNA, 23 nt, Artificial Sequence
  source: /note="Description of Artificial Sequence: Synthetic oligonucleotide"
uugcagcagcucuucagaacgcc

SEQ ID NO: 2916 - RNA, 23 nt, Artificial Sequence
  source: /note="Description of Artificial Sequence: Synthetic oligonucleotide"
gacgguaccgacaaccaguauuu

SEQ ID NO: 2917 - RNA, 23 nt, Artificial Sequence
  source: /note="Description of Artificial Sequence: Synthetic oligonucleotide"
acaucuugaacuacaucgaucau

SEQ ID NO: 2918 - RNA, 23 nt, Artificial Sequence
  source: /note="Description of Artificial Sequence: Synthetic oligonucleotide"
caucuugaacuacaucgaucaug

SEQ ID NO: 2919 - RNA, 23 nt, Artificial Sequence
  source: /note="Description of Artificial Sequence: Synthetic oligonucleotide"
cuuuggcggauugcauuccuuug

SEQ ID NO: 2920 - RNA, 23 nt, Artificial Sequence
  source: /note="Description of Artificial Sequence: Synthetic oligonucleotide"
cagcuacagugaguuaggacugc

SEQ ID NO: 2921 - RNA, 23 nt, Artificial Sequence
  source: /note="Description of Artificial Sequence: Synthetic oligonucleotide"
cugaggaacaguuccuauuggcu

SEQ ID NO: 2922 - RNA, 23 nt, Artificial Sequence
  source: /note="Description of Artificial Sequence: Synthetic oligonucleotide"
auagaggcuauaaccuacuacca

SEQ ID NO: 2923 - RNA, 23 nt, Artificial Sequence
  source: /note="Description of Artificial Sequence: Synthetic oligonucleotide"
cucagaugagucuaggaagagcu

SEQ ID NO: 2924 - RNA, 23 nt, Artificial Sequence
  source: /note="Description of Artificial Sequence: Synthetic oligonucleotide"
agaacaagcaucuguaccguuga

SEQ ID NO: 2925 - RNA, 23 nt, Artificial Sequence
  source: /note="Description of Artificial Sequence: Synthetic oligonucleotide"
caagcaucuguaccguugagucc

SEQ ID NO: 2926 - RNA, 23 nt, Artificial Sequence
  source: /note="Description of Artificial Sequence: Synthetic oligonucleotide"
ccucagguccuguuacaacaagu

SEQ ID NO: 2927 - RNA, 23 nt, Artificial Sequence
  source: /note="Description of Artificial Sequence: Synthetic oligonucleotide"
ccuucauaccucaaacugcauga

SEQ ID NO: 2928 - RNA, 23 nt, Artificial Sequence
  source: /note="Description of Artificial Sequence: Synthetic oligonucleotide"
auaccucaaacugcaugaugucc

SEQ ID NO: 2929 - RNA, 23 nt, Artificial Sequence
  source: /note="Description of Artificial Sequence: Synthetic oligonucleotide"
ugcaggacauugggaaguguguu

SEQ ID NO: 2930 - RNA, 23 nt, Artificial Sequence
  source: /note="Description of Artificial Sequence: Synthetic oligonucleotide"
gaaauccugcuuuagucgagaac

SEQ ID NO: 2931 - RNA, 23 nt, Artificial Sequence
  source: /note="Description of Artificial Sequence: Synthetic oligonucleotide"
augauggcaacuguuuguguuca

SEQ ID NO: 2932 - RNA, 23 nt, Artificial Sequence
  source: /note="Description of Artificial Sequence: Synthetic oligonucleotide"
cgagugucacaaagaaccgugca

SEQ ID NO: 2933 - RNA, 23 nt, Artificial Sequence
  source: /note="Description of Artificial Sequence: Synthetic oligonucleotide"
cagcugguucaguuacggguuaa

SEQ ID NO: 2934 - RNA, 23 nt, Artificial Sequence
  source: /note="Description of Artificial Sequence: Synthetic oligonucleotide"
aguuacggguuaauuacugucuu

SEQ ID NO: 2935 - RNA, 23 nt, Artificial Sequence
  source: /note="Description of Artificial Sequence: Synthetic oligonucleotide"
aagcgacugucucgacagauagc

SEQ ID NO: 2936 - RNA, 23 nt, Artificial Sequence
  source: /note="Description of Artificial Sequence: Synthetic oligonucleotide"
agcgacugucucgacagauagcu

SEQ ID NO: 2937 - RNA, 23 nt, Artificial Sequence
  source: /note="Description of Artificial Sequence: Synthetic oligonucleotide"
cucccaauguuagccaaacagca

SEQ ID NO: 2938 - RNA, 23 nt, Artificial Sequence
  source: /note="Description of Artificial Sequence: Synthetic oligonucleotide"
ugcacauugacucucaugaagcc

SEQ ID NO: 2939 - RNA, 23 nt, Artificial Sequence
  source: /note="Description of Artificial Sequence: Synthetic oligonucleotide"
gugagcacuguucaacuguggau

SEQ ID NO: 2940 - RNA, 23 nt, Artificial Sequence
  source: /note="Description of Artificial Sequence: Synthetic oligonucleotide"
gagugagcagcaacauacuuucu

SEQ ID NO: 2941 - RNA, 23 nt, Artificial Sequence
  source: /note="Description of Artificial Sequence: Synthetic oligonucleotide"
ugcugcuugucaaccacaccgac

SEQ ID NO: 2942 - RNA, 23 nt, Artificial Sequence
  source: /note="Description of Artificial Sequence: Synthetic oligonucleotide"
acuccgagcacuuaacguggcuc

SEQ ID NO: 2943 - RNA, 23 nt, Artificial Sequence
  source: /note="Description of Artificial Sequence: Synthetic oligonucleotide"
agccuccaguacaggacuucauc

SEQ ID NO: 2944 - RNA, 23 nt, Artificial Sequence
  source: /note="Description of Artificial Sequence: Synthetic oligonucleotide"
auggucgacauccuugcuugucg

SEQ ID NO: 2945 - RNA, 23 nt, Artificial Sequence
  source: /note="Description of Artificial Sequence: Synthetic oligonucleotide"
ugcuggacagguuucgucucucc

SEQ ID NO: 2946 - RNA, 23 nt, Artificial Sequence
  source: /note="Description of Artificial Sequence: Synthetic oligonucleotide"
cgugucacuggaaacagugaguc

SEQ ID NO: 2947 - RNA, 23 nt, Artificial Sequence
  source: /note="Description of Artificial Sequence: Synthetic oligonucleotide"
ugaacucggaguucaaccuaagc

SEQ ID NO: 2948 - RNA, 23 nt, Artificial Sequence
  source: /note="Description of Artificial Sequence: Synthetic oligonucleotide"
uacuggagcaaguugaaugaucu

SEQ ID NO: 2949 - RNA, 23 nt, Artificial Sequence
  source: /note="Description of Artificial Sequence: Synthetic oligonucleotide"
ggagagcagcuucuuaguccaga

SEQ ID NO: 2950 - RNA, 23 nt, Artificial Sequence
  source: /note="Description of Artificial Sequence: Synthetic oligonucleotide"
cccuugucaacagcuacacacgu

SEQ ID NO: 2951 - RNA, 23 nt, Artificial Sequence
  source: /note="Description of Artificial Sequence: Synthetic oligonucleotide"
cuggaccagucguacucaguuug

SEQ ID NO: 2952 - RNA, 23 nt, Artificial Sequence
  source: /note="Description of Artificial Sequence: Synthetic oligonucleotide"
ccucauugagaacuauccucugg

SEQ ID NO: 2953 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucuaaucutccaagguuaa

SEQ ID NO: 2954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcagugutgauaaauuua

SEQ ID NO: 2955 - RNA, 21 nt, Artificial Sequence
  source: /note="Description of Artificial Sequence: Synthetic oligonucleotide"
uucuccgucagcacaauaaca

SEQ ID NO: 2956 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggaagagctguaccguuga

SEQ ID NO: 2957 - RNA, 21 nt, Artificial Sequence
  source: /note="Description of Artificial Sequence: Synthetic oligonucleotide"
uuguguucaacaauuguugaa

SEQ ID NO: 2958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaaggtuacagcucgaga

SEQ ID NO: 2959 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucugaatcgagaucggaua

SEQ ID NO: 2960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauaaautuguguugagaga

SEQ ID NO: 2961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuauaaagutccucuugaca

SEQ ID NO: 2962 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggaacagtuccuauugga

SEQ ID NO: 2963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucauugtctgacaauauga

SEQ ID NO: 2964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaaggutacagcucgagca

SEQ ID NO: 2965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuugaactacaucgauca

SEQ ID NO: 2966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggaacagutccuauuggca

SEQ ID NO: 2967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagagctgtaccguuggga

SEQ ID NO: 2968 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaagcatctguaccguuga

SEQ ID NO: 2969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuguggaactuauagcugga

SEQ ID NO: 2970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugaaatuguguuagacga

SEQ ID NO: 2971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucagcuuggtucccauugga

SEQ ID NO: 2972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugaaaucctgcuuuaguca

SEQ ID NO: 2973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaaautgtguuagacgga

SEQ ID NO: 2974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuuguccatuguguccgca

SEQ ID NO: 2975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaacuacatcgaucaugga

SEQ ID NO: 2976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagugcucaataauguuguca

SEQ ID NO: 2977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuugcatutggaguuuaga

SEQ ID NO: 2978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuuggutcccauuggauca

SEQ ID NO: 2979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaugcuautcauaaucaca

SEQ ID NO: 2980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaucaaagctuugauggaua

SEQ ID NO: 2981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugcugautcuuggcguga

SEQ ID NO: 2982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgccuutuaucugcuucga

SEQ ID NO: 2983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacuacatcgaucauggaga

SEQ ID NO: 2984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuugcautuggaguuuagga

SEQ ID NO: 2985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugcuutgauuuuggccga

SEQ ID NO: 2986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaauccugctuuagucgaga

SEQ ID NO: 2987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuauucataaucacauucga

SEQ ID NO: 2988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcuugtccagguuuauga

SEQ ID NO: 2989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaugactctgaaucgagaa

SEQ ID NO: 2990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaauugtgtuagacgguaa

SEQ ID NO: 2991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccuuutatcugcuucgua

SEQ ID NO: 2992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuggcggatugcauuccua

SEQ ID NO: 2993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccauctcauuucuccgua

SEQ ID NO: 2994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccggaaactugcuugcaga

SEQ ID NO: 2995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauucuaatctuccaagguua

SEQ ID NO: 2996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagguuuatgaacugacguua

SEQ ID NO: 2997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguauugtggaacuuauaga

SEQ ID NO: 2998 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaauugugutagacgguaca

SEQ ID NO: 2999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuggcggautgcauuccuua

SEQ ID NO: 3000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccaucucatuucuccguca

SEQ ID NO: 3001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucucuaagtcccauccgaa

SEQ ID NO: 3002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacggagtatguucgucaca

SEQ ID NO: 3003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaacauacutucuauugcca

SEQ ID NO: 3004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccuucatgaugaacucgga

SEQ ID NO: 3005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugacuugtutacgaaaugua

SEQ ID NO: 3006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucacauucgtuuguuugaaa

SEQ ID NO: 3007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguuacgggtuaauuacuga

SEQ ID NO: 3008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccaggcaatucagucucga

SEQ ID NO: 3009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggucgacatccuugcuuga

SEQ ID NO: 3010 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucaugatgaacucggagua

SEQ ID NO: 3011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacuugutuacgaaauguca

SEQ ID NO: 3012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuugaacctcuuguuauaa

SEQ ID NO: 3013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaucaggtguuuauugga

SEQ ID NO: 3014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccuuggagtguuaaauaca

SEQ ID NO: 3015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagauauugutcuuucucgua

SEQ ID NO: 3016 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaggcaautcagucucgua

SEQ ID NO: 3017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucgacaucctugcuugucga

SEQ ID NO: 3018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuagctccaugcuuaaga

SEQ ID NO: 3019 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagucgtacucaguuugaa

SEQ ID NO: 3020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagacaugcutuuacggagua

SEQ ID NO: 3021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauauugutctuucucguaua

SEQ ID NO: 3022 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaggcaatucagucucguua

SEQ ID NO: 3023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugcaagactcacuuaguca

SEQ ID NO: 3024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagucguactcaguuugaaa

SEQ ID NO: 3025 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaugcccgtguaaaguaua

SEQ ID NO: 3026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaacctctuguuauaaaa

SEQ ID NO: 3027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaugaacgctaucauucaaa

SEQ ID NO: 3028 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugcuutuacggaguauga

SEQ ID NO: 3029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguucuutctcguauucaga

SEQ ID NO: 3030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacaaagutacuuagucca

SEQ ID NO: 3031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggcaautcagucucguuga

SEQ ID NO: 3032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacgcuaucatucaaaacaga

SEQ ID NO: 3033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggaggautcugacuugga

SEQ ID NO: 3034 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaacagctacacacguga

SEQ ID NO: 3035 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcugagcatuaucagagga

SEQ ID NO: 3036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcugacautuccguuguaa

SEQ ID NO: 3037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuacggagtauguucguca

SEQ ID NO: 3038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuucaaggtuucuauuaca

SEQ ID NO: 3039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaauucagtcucguuguga

SEQ ID NO: 3040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuggugaatcggauuccua

SEQ ID NO: 3041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcugcugactuguuuacgaa

SEQ ID NO: 3042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacugucatgtggcuugguua

SEQ ID NO: 3043 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagguuuctatuacaacugga

SEQ ID NO: 3044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaacagctacacacguguga

SEQ ID NO: 3045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcugactuguuuacgaaaa

SEQ ID NO: 3046 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacggtcuuucutgguagcuga

SEQ ID NO: 3047 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaacctuggaagautagaaucc

SEQ ID NO: 3048 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaacgtcagutcauaaaccugg

SEQ ID NO: 3049 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccgatcucgautcagagucau

SEQ ID NO: 3050 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaatutaucaacactgcuguca

SEQ ID NO: 3051 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaataggaactgtuccucagag

SEQ ID NO: 3052 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguuautgugctgacggagaaau

SEQ ID NO: 3053 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacgguacagctctuccuaga

SEQ ID NO: 3054 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugucggaugggactuagagaagg

SEQ ID NO: 3055 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcaacaauugtugaacacaaac

SEQ ID NO: 3056 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacacggucutucutgguagcu

SEQ ID NO: 3057 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucgagcuguaacctuggaaga

SEQ ID NO: 3058 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaacgucagtucataaaccug

SEQ ID NO: 3059 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagctataagutccacaauacuc

SEQ ID NO: 3060 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccgaucucgatucagaguca

SEQ ID NO: 3061 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuctcaacacaaautuaucaac

SEQ ID NO: 3062 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugucaagaggaactutauagagu

SEQ ID NO: 3063 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaggaacugutccucaga

SEQ ID NO: 3064 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggutatugugcugacggagaaa

SEQ ID NO: 3065 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtacagaugctuguucuccu

SEQ ID NO: 3066 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacggtucuutgtgacacucgu

SEQ ID NO: 3067 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauautgucagacaaugauuca

SEQ ID NO: 3068 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcucgagcugtaaccuuggaag

SEQ ID NO: 3069 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugtaacgucagtucauaaacc

SEQ ID NO: 3070 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagcuauaagtuccacaauacu

SEQ ID NO: 3071 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauccgaucucgautcagaguc

SEQ ID NO: 3072 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccggutcaguagcutcaucucu

SEQ ID NO: 3073 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucgauguagutcaagauguc

SEQ ID NO: 3074 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugccaataggaactgtuccucag

SEQ ID NO: 3075 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggutauugtgcugacggaga

SEQ ID NO: 3076 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucccaacgguacagctcuuccua

SEQ ID NO: 3077 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacgguacagatgcuuguucu

SEQ ID NO: 3078 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugcacgguucutugugacacu

SEQ ID NO: 3079 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacatauugtcagacaaugau

SEQ ID NO: 3080 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagccataauutugggaacagcu

SEQ ID NO: 3081 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacatuguggucutggugcugug

SEQ ID NO: 3082 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccagctauaagutccacaauac

SEQ ID NO: 3083 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgucuaacacaatutcagaacu

SEQ ID NO: 3084 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugatcgauguagtucaagau

SEQ ID NO: 3085 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauuautgagcactcguucuugc

SEQ ID NO: 3086 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaauaacuctugaaagguuau

SEQ ID NO: 3087 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactaaagcaggautucaggua

SEQ ID NO: 3088 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugautatgaauagcatucuuauc

SEQ ID NO: 3089 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugauaacuuugtugaggcauucg

SEQ ID NO: 3090 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacatuguggucutggugcug

SEQ ID NO: 3091 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgatucagagtcauccuccaag

SEQ ID NO: 3092 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccgtctaacacaautucagaac

SEQ ID NO: 3093 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcggacacaatggacaagaggu

SEQ ID NO: 3094 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccatgaucgatgtaguucaaga

SEQ ID NO: 3095 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacaacauuatugagcacucgu

SEQ ID NO: 3096 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaaacuccaaatgcaaacugg

SEQ ID NO: 3097 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgacuaaagcaggatuucaggu

SEQ ID NO: 3098 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccatcaaagctutgauaacu

SEQ ID NO: 3099 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaacauuguggtctuggugcu

SEQ ID NO: 3100 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucgatucagagtcauccucca

SEQ ID NO: 3101 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccgucuaacacaatuucagaa

SEQ ID NO: 3102 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuccatgaucgatgtaguucaa

SEQ ID NO: 3103 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaaugugautatgaauagcau

SEQ ID NO: 3104 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagatuagaauccaucaaagcuu

SEQ ID NO: 3105 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacaacauugtggucuuggugc

SEQ ID NO: 3106 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcucgauucagagucauccucc

SEQ ID NO: 3107 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaccgtcuaacacaauuucaga

SEQ ID NO: 3108 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaagcagataaaaggcggac

SEQ ID NO: 3109 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggaatgcaatccgccaaagaa

SEQ ID NO: 3110 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggagaaaugagatggaggcu

SEQ ID NO: 3111 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtacagcucutccuagacuc

SEQ ID NO: 3112 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugcaagcaagutuccggccaa

SEQ ID NO: 3113 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaacgaaugtgautaugaaua

SEQ ID NO: 3114 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccutggaagatuagaaucca

SEQ ID NO: 3115 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgucaguucataaaccugga

SEQ ID NO: 3116 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuataaguuccacaauacuccc

SEQ ID NO: 3117 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauctcgauucagagtcauccuc

SEQ ID NO: 3118 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacggagaaatgagauggaggc

SEQ ID NO: 3119 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgguacagctctuccuagacu

SEQ ID NO: 3120 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcggatgggacutagagaaggg

SEQ ID NO: 3121 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaucatuggutctcgacuaaag

SEQ ID NO: 3122 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaaacgaaugugatuaugaau

SEQ ID NO: 3123 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautaacccgtaacugaacc

SEQ ID NO: 3124 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagcuaucugtcgagacagucg

SEQ ID NO: 3125 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugacgaacatacuccguaaaa

SEQ ID NO: 3126 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcaatagaaagtatguugcug

SEQ ID NO: 3127 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccacgtuaagtgcucggaguca

SEQ ID NO: 3128 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacaacgagactgaauugccu

SEQ ID NO: 3129 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccgagtucaucatgaaggcauu

SEQ ID NO: 3130 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucgcaguuctgtcagcgucac

SEQ ID NO: 3131 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacatutcguaaacaagucagca

SEQ ID NO: 3132 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucaaacaaacgaatgugauua

SEQ ID NO: 3133 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaauuaacccgtaacugaa

SEQ ID NO: 3134 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutaacacuccaagggcuuca

SEQ ID NO: 3135 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtugacugggaaaucagaac

SEQ ID NO: 3136 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacautccagactugaagaugu

SEQ ID NO: 3137 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgagacugaatugccuggauga

SEQ ID NO: 3138 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaagcaaggatgtcgaccaugc

SEQ ID NO: 3139 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuccgaguucatcaugaaggc

SEQ ID NO: 3140 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauaacaagaggtucaaacaaa

SEQ ID NO: 3141 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaaacacctgaucugaau

SEQ ID NO: 3142 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguatutaacacuccaagggcuu

SEQ ID NO: 3143 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgagaaagaacaataucuuca

SEQ ID NO: 3144 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgagacugaautgccuggaug

SEQ ID NO: 3145 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuuaagcauggagctagcaggc

SEQ ID NO: 3146 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcaaacugagtacgacuggucc

SEQ ID NO: 3147 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggactgacutucuccuuuccu

SEQ ID NO: 3148 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcatagaaagagtuacguuaaa

SEQ ID NO: 3149 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuataacaagaggutcaaacaa

SEQ ID NO: 3150 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtutcaauacaaagccaaua

SEQ ID NO: 3151 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuccguaaaagcatgucuacc

SEQ ID NO: 3152 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccggaacautccagacuugaa

SEQ ID NO: 3153 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgagacugaatugccuggau

SEQ ID NO: 3154 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactaagugagucutgcauggu

SEQ ID NO: 3155 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcutaagcauggagcuagcagg

SEQ ID NO: 3156 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucaaacugaguacgacugguc

SEQ ID NO: 3157 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggatuagggucugaaguucuac

SEQ ID NO: 3158 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauacutuacacgggcauagaaa

SEQ ID NO: 3159 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuuauaacaagaggtucaaaca

SEQ ID NO: 3160 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugaatgauagcgutcauaaga

SEQ ID NO: 3161 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggacuaaguaactutgugcugg

SEQ ID NO: 3162 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacgagacugaautgccugga

SEQ ID NO: 3163 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggacuaagugagtctugcaugg

SEQ ID NO: 3164 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautcaactugctccaguag

SEQ ID NO: 3165 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuucaaacugagtacgacuggu

SEQ ID NO: 3166 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccgatgacutugutcaugaug

SEQ ID NO: 3167 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauactuuacacgggcauagaa

SEQ ID NO: 3168 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguguacugututaaagcuuuu

SEQ ID NO: 3169 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtutugaatgauagcguuca

SEQ ID NO: 3170 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaacauactccgtaaaagca

SEQ ID NO: 3171 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaagtcagaaucctccucuuc

SEQ ID NO: 3172 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaacgagactgaatugccugg

SEQ ID NO: 3173 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggactcacugutuccagugac

SEQ ID NO: 3174 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacguguguagctgtugacaag

SEQ ID NO: 3175 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccucugauaatgcucagcuucc

SEQ ID NO: 3176 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaaacaagtcagcagccggu

SEQ ID NO: 3177 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacaacggaaaugucagcgggu

SEQ ID NO: 3178 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacccguaactgaaccagcugc

SEQ ID NO: 3179 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugucgagacagtcgctuccacuu

SEQ ID NO: 3180 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaauagaaacctugaaaaugu

SEQ ID NO: 3181 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucguacuautucucuauugca

SEQ ID NO: 3182 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggaatccgatucaccagcucu

SEQ ID NO: 3183 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacacgtguguagcuguugacaa

SEQ ID NO: 3184 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcgtaaacaagucagcagccgg

SEQ ID NO: 3185 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccaagccacatgacagucgc

SEQ ID NO: 3186 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaatuaacccguaacugaacca

SEQ ID NO: 3187 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagctatcugucgagacagucgc

SEQ ID NO: 3188 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgacgaacauactccguaaaag

SEQ ID NO: 3189 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccagutguaatagaaaccuuga

SEQ ID NO: 3190 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacgutaagugctcggagucau

SEQ ID NO: 3191 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggaauccgautcaccagcuc

SEQ ID NO: 3192 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacacgugugtagctguugaca

SEQ ID NO: 3193 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuucgtaaacaagucagcagcc

SEQ ID NO: 3194 - RNA, 21 nt, Artificial Sequence
  source: /note="Description of Artificial Sequence: Synthetic oligonucleotide"
agcuaccaagaaagaccguga

SEQ ID NO: 3195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucuaaucutccaagguuaa

SEQ ID NO: 3196 - RNA, 21 nt, Artificial Sequence
  source: /note="Description of Artificial Sequence: Synthetic oligonucleotide"
agguuuaugaacugacguuaa

SEQ ID NO: 3197 - RNA, 21 nt, Artificial Sequence
  source: /note="Description of Artificial Sequence: Synthetic oligonucleotide"
aguauuguggaacuuauagca

SEQ ID NO: 3198 - RNA, 21 nt, Artificial Sequence
  source: /note="Description of Artificial Sequence: Synthetic oligonucleotide"
gacucugaaucgagaucggaa

SEQ ID NO: 3199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcagugutgauaaauuua

SEQ ID NO: 3200 - RNA, 21 nt, Artificial Sequence
  source: /note="Description of Artificial Sequence: Synthetic oligonucleotide"
cgccuuuuaucugcuucguua

SEQ ID NO: 3201 - RNA, 21 nt, Artificial Sequence
  source: /note="Description of Artificial Sequence: Synthetic oligonucleotide"
cugaggaacaguuccuauuga

SEQ ID NO: 3202 - RNA, 21 nt, Artificial Sequence
  source: /note="Description of Artificial Sequence: Synthetic oligonucleotide"
uucuccgucagcacaauaaca

SEQ ID NO: 3203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggaagagctguaccguuga

SEQ ID NO: 3204 - RNA, 21 nt, Artificial Sequence
  source: /note="Description of Artificial Sequence: Synthetic oligonucleotide"
uucucuaagucccauccgaca

SEQ ID NO: 3205 - RNA, 21 nt, Artificial Sequence
  source: /note="Description of Artificial Sequence: Synthetic oligonucleotide"
uuguguucaacaauuguugaa

SEQ ID NO: 3206 - RNA, 21 nt, Artificial Sequence
  source: /note="Description of Artificial Sequence: Synthetic oligonucleotide"
cuaccaagaaagaccguguga

SEQ ID NO: 3207 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaaggtuacagcucgaga

SEQ ID NO: 3208 - RNA, 21 nt, Artificial Sequence
  source: /note="Description of Artificial Sequence: Synthetic oligonucleotide"
gguuuaugaacugacguuaca

SEQ ID NO: 3209 - RNA, 21 nt, Artificial Sequence
  source: /note="Description of Artificial Sequence: Synthetic oligonucleotide"
guauuguggaacuuauagcua

SEQ ID NO: 3210 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucugaatcgagaucggaua

SEQ ID NO: 3211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauaaautuguguugagaga

SEQ ID NO: 3212 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuauaaagutccucuugaca

SEQ ID NO: 3213 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggaacagtuccuauugga

SEQ ID NO: 3214 - RNA, 21 nt, Artificial Sequence
  source: /note="Description of Artificial Sequence: Synthetic oligonucleotide"
ucuccgucagcacaauaacca

SEQ ID NO: 3215 - RNA, 21 nt, Artificial Sequence
  source: /note="Description of Artificial Sequence: Synthetic oligonucleotide"
aggaagagcuguaccguugga

SEQ ID NO: 3216 - RNA, 21 nt, Artificial Sequence
  source: /note="Description of Artificial Sequence: Synthetic oligonucleotide"
gagaacaagcaucuguaccga

SEQ ID NO: 3217 - RNA, 21 nt, Artificial Sequence
  source: /note="Description of Artificial Sequence: Synthetic oligonucleotide"
gagugucacaaagaaccguga

SEQ ID NO: 3218 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucauugtctgacaauauga

SEQ ID NO: 3219 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaaggutacagcucgagca

SEQ ID NO: 3220 - RNA, 21 nt, Artificial Sequence
  source: /note="Description of Artificial Sequence: Synthetic oligonucleotide"
uuuaugaacugacguuacaua

SEQ ID NO: 3221 - RNA, 21 nt, Artificial Sequence
  source: /note="Description of Artificial Sequence: Synthetic oligonucleotide"
uauuguggaacuuauagcuga

SEQ ID NO: 3222 - RNA, 21 nt, Artificial Sequence
  source: /note="Description of Artificial Sequence: Synthetic oligonucleotide"
cucugaaucgagaucggauga

SEQ ID NO: 3223 - RNA, 21 nt, Artificial Sequence
  source: /note="Description of Artificial Sequence: Synthetic oligonucleotide"
agaugaagcuacugaaccgga

SEQ ID NO: 3224 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuugaactacaucgauca

SEQ ID NO: 3225 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggaacagutccuauuggca

SEQ ID NO: 3226 - RNA, 21 nt, Artificial Sequence
  source: /note="Description of Artificial Sequence: Synthetic oligonucleotide"
uccgucagcacaauaaccaga

SEQ ID NO: 3227 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagagctgtaccguuggga

SEQ ID NO: 3228 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaagcatctguaccguuga

SEQ ID NO: 3229 - RNA, 21 nt, Artificial Sequence
  source: /note="Description of Artificial Sequence: Synthetic oligonucleotide"
ugucacaaagaaccgugcaga

SEQ ID NO: 3230 - RNA, 21 nt, Artificial Sequence
  source: /note="Description of Artificial Sequence: Synthetic oligonucleotide"
cauugucugacaauaugugaa

SEQ ID NO: 3231 - RNA, 21 nt, Artificial Sequence
  source: /note="Description of Artificial Sequence: Synthetic oligonucleotide"
cuguucccaaaauuauggcua

SEQ ID NO: 3232 - RNA, 21 nt, Artificial Sequence
  source: /note="Description of Artificial Sequence: Synthetic oligonucleotide"
cagcaccaagaccacaaugua

SEQ ID NO: 3233 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuguggaactuauagcugga

SEQ ID NO: 3234 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugaaatuguguuagacga

SEQ ID NO: 3235 - RNA, 21 nt, Artificial Sequence
  source: /note="Description of Artificial Sequence: Synthetic oligonucleotide"
ccucuuguccauuguguccga

SEQ ID NO: 3236 - RNA, 21 nt, Artificial Sequence
  source: /note="Description of Artificial Sequence: Synthetic oligonucleotide"
cuugaacuacaucgaucauga

SEQ ID NO: 3237 - RNA, 21 nt, Artificial Sequence
  source: /note="Description of Artificial Sequence: Synthetic oligonucleotide"
aagaacgagugcucaauaaua

SEQ ID NO: 3238 - RNA, 21 nt, Artificial Sequence
  source: /note="Description of Artificial Sequence: Synthetic oligonucleotide"
aaccuuucaagaguuauugca

SEQ ID NO: 3239 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucagcuuggtucccauugga

SEQ ID NO: 3240 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugaaaucctgcuuuaguca

SEQ ID NO: 3241 - RNA, 21 nt, Artificial Sequence
  source: /note="Description of Artificial Sequence: Synthetic oligonucleotide"
uaagaaugcuauucauaauca

SEQ ID NO: 3242 - RNA, 21 nt, Artificial Sequence
  source: /note="Description of Artificial Sequence: Synthetic oligonucleotide"
aaugccucaacaaaguuauca

SEQ ID NO: 3243 - RNA, 21 nt, Artificial Sequence
  source: /note="Description of Artificial Sequence: Synthetic oligonucleotide"
aggccuucauagcgaaccuga

SEQ ID NO: 3244 - RNA, 21 nt, Artificial Sequence
  source: /note="Description of Artificial Sequence: Synthetic oligonucleotide"
gcaccaagaccacaauguuga

SEQ ID NO: 3245 - RNA, 21 nt, Artificial Sequence
  source: /note="Description of Artificial Sequence: Synthetic oligonucleotide"
uggaggaugacucugaaucga

SEQ ID NO: 3246 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaaautgtguuagacgga

SEQ ID NO: 3247 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuuguccatuguguccgca

SEQ ID NO: 3248 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaacuacatcgaucaugga

SEQ ID NO: 3249 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagugcucaataauguuguca

SEQ ID NO: 3250 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuugcatutggaguuuaga

SEQ ID NO: 3251 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuuggutcccauuggauca

SEQ ID NO: 3252 - RNA, 21 nt, Artificial Sequence
  source: /note="Description of Artificial Sequence: Synthetic oligonucleotide"
cugaaauccugcuuuagucga

SEQ ID NO: 3253 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaugcuautcauaaucaca

SEQ ID NO: 3254 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaucaaagctuugauggaua

SEQ ID NO: 3255 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugcugautcuuggcguga

SEQ ID NO: 3256 - RNA, 21 nt, Artificial Sequence
  source: /note="Description of Artificial Sequence: Synthetic oligonucleotide"
caccaagaccacaauguugua

SEQ ID NO: 3257 - RNA, 21 nt, Artificial Sequence
  source: /note="Description of Artificial Sequence: Synthetic oligonucleotide"
gaggaugacucugaaucgaga

SEQ ID NO: 3258 - RNA, 21 nt, Artificial Sequence
  source: /note="Description of Artificial Sequence: Synthetic oligonucleotide"
cugaaauuguguuagacggua

SEQ ID NO: 3259 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgccuutuaucugcuucga

SEQ ID NO: 3260 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacuacatcgaucauggaga

SEQ ID NO: 3261 - RNA, 21 nt, Artificial Sequence
  source: /note="Description of Artificial Sequence: Synthetic oligonucleotide"
gccuccaucucauuucuccga

SEQ ID NO: 3262 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuugcautuggaguuuagga

SEQ ID NO: 3263 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugcuutgauuuuggccga

SEQ ID NO: 3264 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaauccugctuuagucgaga

SEQ ID NO: 3265 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuauucataaucacauucga

SEQ ID NO: 3266 - RNA, 21 nt, Artificial Sequence
  source: /note="Description of Artificial Sequence: Synthetic oligonucleotide"
gcuuugauggauucuaaucua

SEQ ID NO: 3267 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcuugtccagguuuauga

SEQ ID NO: 3268 - RNA, 21 nt, Artificial Sequence
  source: /note="Description of Artificial Sequence: Synthetic oligonucleotide"
accaagaccacaauguuguga

SEQ ID NO: 3269 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaugactctgaaucgagaa

SEQ ID NO: 3270 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaauugtgtuagacgguaa

SEQ ID NO: 3271 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccuuutatcugcuucgua

SEQ ID NO: 3272 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuggcggatugcauuccua

SEQ ID NO: 3273 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccauctcauuucuccgua

SEQ ID NO: 3274 - RNA, 21 nt, Artificial Sequence
  source: /note="Description of Artificial Sequence: Synthetic oligonucleotide"
gucuaggaagagcuguaccga

SEQ ID NO: 3275 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccggaaactugcuugcaga

SEQ ID NO: 3276 - RNA, 21 nt, Artificial Sequence
  source: /note="Description of Artificial Sequence: Synthetic oligonucleotide"
uuuagucgagaaccaaugaua

SEQ ID NO: 3277 - RNA, 21 nt, Artificial Sequence
  source: /note="Description of Artificial Sequence: Synthetic oligonucleotide"
uucauaaucacauucguuuga

SEQ ID NO: 3278 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauucuaatctuccaagguua

SEQ ID NO: 3279 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagguuuatgaacugacguua

SEQ ID NO: 3280 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguauugtggaacuuauaga

SEQ ID NO: 3281 - RNA, 21 nt, Artificial Sequence
  source: /note="Description of Artificial Sequence: Synthetic oligonucleotide"
ggaugacucugaaucgagaua

SEQ ID NO: 3282 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaauugugutagacgguaca

SEQ ID NO: 3283 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuggcggautgcauuccuua

SEQ ID NO: 3284 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccaucucatuucuccguca

SEQ ID NO: 3285 - RNA, 21 nt, Artificial Sequence
  source: /note="Description of Artificial Sequence: Synthetic oligonucleotide"
ucuaggaagagcuguaccgua

SEQ ID NO: 3286 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucucuaagtcccauccgaa

SEQ ID NO: 3287 - RNA, 21 nt, Artificial Sequence
  source: /note="Description of Artificial Sequence: Synthetic oligonucleotide"
uuagucgagaaccaaugauga

SEQ ID NO: 3288 - RNA, 21 nt, Artificial Sequence
  source: /note="Description of Artificial Sequence: Synthetic oligonucleotide"
ucauaaucacauucguuugua

SEQ ID NO: 3289 - RNA, 21 nt, Artificial Sequence
  source: /note="Description of Artificial Sequence: Synthetic oligonucleotide"
uucaguuacggguuaauuaca

SEQ ID NO: 3290 - RNA, 21 nt, Artificial Sequence
  source: /note="Description of Artificial Sequence: Synthetic oligonucleotide"
acugucucgacagauagcuga

SEQ ID NO: 3291 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacggagtatguucgucaca

SEQ ID NO: 3292 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaacauacutucuauugcca

SEQ ID NO: 3293 - RNA, 21 nt, Artificial Sequence
  source: /note="Description of Artificial Sequence: Synthetic oligonucleotide"
acuccgagcacuuaacgugga

SEQ ID NO: 3294 - RNA, 21 nt, Artificial Sequence
  source: /note="Description of Artificial Sequence: Synthetic oligonucleotide"
gcaauucagucucguugugaa

SEQ ID NO: 3295 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccuucatgaugaacucgga

SEQ ID NO: 3296 - RNA, 21 nt, Artificial Sequence
  source: /note="Description of Artificial Sequence: Synthetic oligonucleotide"
caacagcuacacacgugugca

SEQ ID NO: 3297 - RNA, 21 nt, Artificial Sequence
  source: /note="Description of Artificial Sequence: Synthetic oligonucleotide"
gacgcugacagaacugcgaaa

SEQ ID NO: 3298 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugacuugtutacgaaaugua

SEQ ID NO: 3299 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucacauucgtuuguuugaaa

SEQ ID NO: 3300 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguuacgggtuaauuacuga

SEQ ID NO: 3301 - RNA, 21 nt, Artificial Sequence
  source: /note="Description of Artificial Sequence: Synthetic oligonucleotide"
aagcccuuggaguguuaaaua

SEQ ID NO: 3302 - RNA, 21 nt, Artificial Sequence
  source: /note="Description of Artificial Sequence: Synthetic oligonucleotide"
ucugauuucccagucaacuga

SEQ ID NO: 3303 - RNA, 21 nt, Artificial Sequence
  source: /note="Description of Artificial Sequence: Synthetic oligonucleotide"
aucuucaagucuggaauguua

SEQ ID NO: 3304 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccaggcaatucagucucga

SEQ ID NO: 3305 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggucgacatccuugcuuga

SEQ ID NO: 3306 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucaugatgaacucggagua

SEQ ID NO: 3307 - RNA, 21 nt, Artificial Sequence
  source: /note="Description of Artificial Sequence: Synthetic oligonucleotide"
gaccagucguacucaguuuga

SEQ ID NO: 3308 - RNA, 21 nt, Artificial Sequence
  source: /note="Description of Artificial Sequence: Synthetic oligonucleotide"
acgcugacagaacugcgaaga

SEQ ID NO: 3309 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacuugutuacgaaauguca

SEQ ID NO: 3310 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuugaacctcuuguuauaa

SEQ ID NO: 3311 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaucaggtguuuauugga

SEQ ID NO: 3312 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccuuggagtguuaaauaca

SEQ ID NO: 3313 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagauauugutcuuucucgua

SEQ ID NO: 3314 - RNA, 21 nt, Artificial Sequence
  source: /note="Description of Artificial Sequence: Synthetic oligonucleotide"
ucaagucuggaauguuccgga

SEQ ID NO: 3315 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaggcaautcagucucgua

SEQ ID NO: 3316 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucgacaucctugcuugucga

SEQ ID NO: 3317 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuagctccaugcuuaaga

SEQ ID NO: 3318 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagucgtacucaguuugaa

SEQ ID NO: 3319 - RNA, 21 nt, Artificial Sequence
  source: /note="Description of Artificial Sequence: Synthetic oligonucleotide"
gaaaggagaaagucaguccga

SEQ ID NO: 3320 - RNA, 21 nt, Artificial Sequence
  source: /note="Description of Artificial Sequence: Synthetic oligonucleotide"
uaacguaacucuuucuaugca

SEQ ID NO: 3321 - RNA, 21 nt, Artificial Sequence
  source: /note="Description of Artificial Sequence: Synthetic oligonucleotide"
guuugaaccucuuguuauaaa

SEQ ID NO: 3322 - RNA, 21 nt, Artificial Sequence
  source: /note="Description of Artificial Sequence: Synthetic oligonucleotide"
uuggcuuuguauugaaacaga

SEQ ID NO: 3323 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagacaugcutuuacggagua

SEQ ID NO: 3324 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauauugutctuucucguaua

SEQ ID NO: 3325 - RNA, 21 nt, Artificial Sequence
  source: /note="Description of Artificial Sequence: Synthetic oligonucleotide"
caagucuggaauguuccggaa

SEQ ID NO: 3326 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaggcaatucagucucguua

SEQ ID NO: 3327 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugcaagactcacuuaguca

SEQ ID NO: 3328 - RNA, 21 nt, Artificial Sequence
  source: /note="Description of Artificial Sequence: Synthetic oligonucleotide"
ugcuagcuccaugcuuaagca

SEQ ID NO: 3329 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagucguactcaguuugaaa

SEQ ID NO: 3330 - RNA, 21 nt, Artificial Sequence
  source: /note="Description of Artificial Sequence: Synthetic oligonucleotide"
agaacuucagacccuaaucca

SEQ ID NO: 3331 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaugcccgtguaaaguaua

SEQ ID NO: 3332 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaacctctuguuauaaaa

SEQ ID NO: 3333 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaugaacgctaucauucaaa

SEQ ID NO: 3334 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaugcuutuacggaguauga

SEQ ID NO: 3335 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguucuutctcguauucaga

SEQ ID NO: 3336 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacaaagutacuuagucca

SEQ ID NO: 3337 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggcaautcagucucguuga

SEQ ID NO: 3338 - RNA, 21 nt, Artificial Sequence
  source: /note="Description of Artificial Sequence: Synthetic oligonucleotide"
augcaagacucacuuagucca

SEQ ID NO: 3339 - RNA, 21 nt, Artificial Sequence
  source: /note="Description of Artificial Sequence: Synthetic oligonucleotide"
acuggagcaaguugaaugaua

SEQ ID NO: 3340 - RNA, 21 nt, Artificial Sequence
  source: /note="Description of Artificial Sequence: Synthetic oligonucleotide"
cagucguacucaguuugaaga

SEQ ID NO: 3341 - RNA, 21 nt, Artificial Sequence
  source: /note="Description of Artificial Sequence: Synthetic oligonucleotide"
ucaugaacaaagucaucggaa

SEQ ID NO: 3342 - RNA, 21 nt, Artificial Sequence
  source: /note="Description of Artificial Sequence: Synthetic oligonucleotide"
cuaugcccguguaaaguauga

SEQ ID NO: 3343 - RNA, 21 nt, Artificial Sequence
  source: /note="Description of Artificial Sequence: Synthetic oligonucleotide"
aagcuuuaaaacaguacacga

SEQ ID NO: 3344 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacgcuaucatucaaaacaga

SEQ ID NO: 3345 - RNA, 21 nt, Artificial Sequence
  source: /note="Description of Artificial Sequence: Synthetic oligonucleotide"
cuuuuacggaguauguucgua

SEQ ID NO: 3346 - RNA, 21 nt, Artificial Sequence
  source: /note="Description of Artificial Sequence: Synthetic oligonucleotide"
uguucuuucucguauucagga

SEQ ID NO: 3347 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggaggautcugacuugga

SEQ ID NO: 3348 - RNA, 21 nt, Artificial Sequence
  source: /note="Description of Artificial Sequence: Synthetic oligonucleotide"
aggcaauucagucucguugua

SEQ ID NO: 3349 - RNA, 21 nt, Artificial Sequence
  source: /note="Description of Artificial Sequence: Synthetic oligonucleotide"
cacuggaaacagugaguccga

SEQ ID NO: 3350 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaacagctacacacguga

SEQ ID NO: 3351 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcugagcatuaucagagga

SEQ ID NO: 3352 - RNA, 21 nt, Artificial Sequence
  source: /note="Description of Artificial Sequence: Synthetic oligonucleotide"
cggcugcugacuuguuuacga

SEQ ID NO: 3353 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcugacautuccguuguaa

SEQ ID NO: 3354 - RNA, 21 nt, Artificial Sequence
  source: /note="Description of Artificial Sequence: Synthetic oligonucleotide"
agcugguucaguuacggguua

SEQ ID NO: 3355 - RNA, 21 nt, Artificial Sequence
  source: /note="Description of Artificial Sequence: Synthetic oligonucleotide"
guggaagcgacugucucgaca

SEQ ID NO: 3356 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuacggagtauguucguca

SEQ ID NO: 3357 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuucaaggtuucuauuaca

SEQ ID NO: 3358 - RNA, 21 nt, Artificial Sequence
  source: /note="Description of Artificial Sequence: Synthetic oligonucleotide"
caauagagaaauaguacgaaa

SEQ ID NO: 3359 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaauucagtcucguuguga

SEQ ID NO: 3360 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuggugaatcggauuccua

SEQ ID NO: 3361 - RNA, 21 nt, Artificial Sequence
  source: /note="Description of Artificial Sequence: Synthetic oligonucleotide"
gucaacagcuacacacgugua

SEQ ID NO: 3362 - RNA, 21 nt, Artificial Sequence
  source: /note="Description of Artificial Sequence: Synthetic oligonucleotide"
uugagcugauguaugugacga

SEQ ID NO: 3363 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcugcugactuguuuacgaa

SEQ ID NO: 3364 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacugucatgtggcuugguua

SEQ ID NO: 3365 - RNA, 21 nt, Artificial Sequence
  source: /note="Description of Artificial Sequence: Synthetic oligonucleotide"
guucaguuacggguuaauuaa

SEQ ID NO: 3366 - RNA, 21 nt, Artificial Sequence
  source: /note="Description of Artificial Sequence: Synthetic oligonucleotide"
gacugucucgacagauagcua

SEQ ID NO: 3367 - RNA, 21 nt, Artificial Sequence
  source: /note="Description of Artificial Sequence: Synthetic oligonucleotide"
uuuacggaguauguucgucaa

SEQ ID NO: 3368 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagguuuctatuacaacugga

SEQ ID NO: 3369 - RNA, 21 nt, Artificial Sequence
  source: /note="Description of Artificial Sequence: Synthetic oligonucleotide"
gacuccgagcacuuaacguga

SEQ ID NO: 3370 - RNA, 21 nt, Artificial Sequence
  source: /note="Description of Artificial Sequence: Synthetic oligonucleotide"
gcuggugaaucggauuccuga

SEQ ID NO: 3371 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaacagctacacacguguga

SEQ ID NO: 3372 - RNA, 21 nt, Artificial Sequence
  source: /note="Description of Artificial Sequence: Synthetic oligonucleotide"
gagcugauguaugugacgcua

SEQ ID NO: 3373 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcugactuguuuacgaaaa

SEQ ID NO: 3374 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacggtcuuucutgguagcuga

SEQ ID NO: 3375 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaacctuggaagautagaaucc

SEQ ID NO: 3376 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaacgtcagutcauaaaccugg

SEQ ID NO: 3377 - RNA, 23 nt, Artificial Sequence
  source: /note="Description of Artificial Sequence: Synthetic oligonucleotide"
ugcuauaaguuccacaauacucc

SEQ ID NO: 3378 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccgatcucgautcagagucau

SEQ ID NO: 3379 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaatutaucaacactgcuguca

SEQ ID NO: 3380 - RNA, 23 nt, Artificial Sequence
  source: /note="Description of Artificial Sequence: Synthetic oligonucleotide"
uaacgaagcagauaaaaggcgga

SEQ ID NO: 3381 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaataggaactgtuccucagag

SEQ ID NO: 3382 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguuautgugctgacggagaaau

SEQ ID NO: 3383 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacgguacagctctuccuaga

SEQ ID NO: 3384 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugucggaugggactuagagaagg

SEQ ID NO: 3385 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcaacaauugtugaacacaaac

SEQ ID NO: 3386 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacacggucutucutgguagcu

SEQ ID NO: 3387 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucgagcuguaacctuggaaga

SEQ ID NO: 3388 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaacgucagtucataaaccug

SEQ ID NO: 3389 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagctataagutccacaauacuc

SEQ ID NO: 3390 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccgaucucgatucagaguca

SEQ ID NO: 3391 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuctcaacacaaautuaucaac

SEQ ID NO: 3392 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugucaagaggaactutauagagu

SEQ ID NO: 3393 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaggaacugutccucaga

SEQ ID NO: 3394 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggutatugugcugacggagaaa

SEQ ID NO: 3395 - RNA, 23 nt, Artificial Sequence
  source: /note="Description of Artificial Sequence: Synthetic oligonucleotide"
uccaacgguacagcucuuccuag

SEQ ID NO: 3396 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtacagaugctuguucuccu

SEQ ID NO: 3397 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacggtucuutgtgacacucgu

SEQ ID NO: 3398 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauautgucagacaaugauuca

SEQ ID NO: 3399 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcucgagcugtaaccuuggaag

SEQ ID NO: 3400 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaugtaacgucagtucauaaacc

SEQ ID NO: 3401 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagcuauaagtuccacaauacu

SEQ ID NO: 3402 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauccgaucucgautcagaguc

SEQ ID NO: 3403 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccggutcaguagcutcaucucu

SEQ ID NO: 3404 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugaucgauguagutcaagauguc

SEQ ID NO: 3405 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugccaataggaactgtuccucag

SEQ ID NO: 3406 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuggutauugtgcugacggaga

SEQ ID NO: 3407 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucccaacgguacagctcuuccua

SEQ ID NO: 3408 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacgguacagatgcuuguucu

SEQ ID NO: 3409 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugcacgguucutugugacacu

SEQ ID NO: 3410 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacatauugtcagacaaugau

SEQ ID NO: 3411 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagccataauutugggaacagcu

SEQ ID NO: 3412 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacatuguggucutggugcugug

SEQ ID NO: 3413 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccagctauaagutccacaauac

SEQ ID NO: 3414 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgucuaacacaatutcagaacu

SEQ ID NO: 3415 - RNA, 23 nt, Artificial Sequence
  source: /note="Description of Artificial Sequence: Synthetic oligonucleotide"
ucggacacaauggacaagaggug

SEQ ID NO: 3416 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaugatcgauguagtucaagau

SEQ ID NO: 3417 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauuautgagcactcguucuugc

SEQ ID NO: 3418 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaauaacuctugaaagguuau

SEQ ID NO: 3419 - RNA, 23 nt, Artificial Sequence
  source: /note="Description of Artificial Sequence: Synthetic oligonucleotide"
uccaaugggaaccaagcugacga

SEQ ID NO: 3420 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactaaagcaggautucaggua

SEQ ID NO: 3421 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugautatgaauagcatucuuauc

SEQ ID NO: 3422 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugauaacuuugtugaggcauucg

SEQ ID NO: 3423 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggutcgcuaugaaggccuuu

SEQ ID NO: 3424 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacatuguggucutggugcug

SEQ ID NO: 3425 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgatucagagtcauccuccaag

SEQ ID NO: 3426 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccgtctaacacaautucagaac

SEQ ID NO: 3427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcggacacaatggacaagaggu

SEQ ID NO: 3428 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccatgaucgatgtaguucaaga

SEQ ID NO: 3429 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacaacauuatugagcacucgu

SEQ ID NO: 3430 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuaaacuccaaatgcaaacugg

SEQ ID NO: 3431 - RNA, 23 nt, Artificial Sequence
  source: /note="Description of Artificial Sequence: Synthetic oligonucleotide"
ugauccaaugggaaccaagcuga

SEQ ID NO: 3432 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgacuaaagcaggatuucaggu

SEQ ID NO: 3433 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugautaugaauagcauucuua

SEQ ID NO: 3434 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauccatcaaagctutgauaacu

SEQ ID NO: 3435 - RNA, 23 nt, Artificial Sequence
  source: /note="Description of Artificial Sequence: Synthetic oligonucleotide"
ucacgccaagaaucagcagagug

SEQ ID NO: 3436 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaacauuguggtctuggugcu

SEQ ID NO: 3437 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucucgatucagagtcauccucca

SEQ ID NO: 3438 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaccgucuaacacaatuucagaa

SEQ ID NO: 3439 - RNA, 23 nt, Artificial Sequence
  source: /note="Description of Artificial Sequence: Synthetic oligonucleotide"
ucgaagcagauaaaaggcggaca

SEQ ID NO: 3440 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuccatgaucgatgtaguucaa

SEQ ID NO: 3441 - RNA, 23 nt, Artificial Sequence
  source: /note="Description of Artificial Sequence: Synthetic oligonucleotide"
ucggagaaaugagauggaggcug

SEQ ID NO: 3442 - RNA, 23 nt, Artificial Sequence
  source: /note="Description of Artificial Sequence: Synthetic oligonucleotide"
uccuaaacuccaaaugcaaacug

SEQ ID NO: 3443 - RNA, 23 nt, Artificial Sequence
  source: /note="Description of Artificial Sequence: Synthetic oligonucleotide"
ucggccaaaaucaaagcaucuug

SEQ ID NO: 3444 - RNA, 23 nt, Artificial Sequence
  source: /note="Description of Artificial Sequence: Synthetic oligonucleotide"
ucucgacuaaagcaggauuucag

SEQ ID NO: 3445 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgaaugugautatgaauagcau

SEQ ID NO: 3446 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagatuagaauccaucaaagcuu

SEQ ID NO: 3447 - RNA, 23 nt, Artificial Sequence
  source: /note="Description of Artificial Sequence: Synthetic oligonucleotide"
ucauaaaccuggacaagcugcuc

SEQ ID NO: 3448 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacaacauugtggucuuggugc

SEQ ID NO: 3449 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcucgauucagagucauccucc

SEQ ID NO: 3450 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaccgtcuaacacaauuucaga

SEQ ID NO: 3451 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaagcagataaaaggcggac

SEQ ID NO: 3452 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggaatgcaatccgccaaagaa

SEQ ID NO: 3453 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacggagaaaugagatggaggcu

SEQ ID NO: 3454 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggtacagcucutccuagacuc

SEQ ID NO: 3455 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugcaagcaagutuccggccaa

SEQ ID NO: 3456 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautgguucucgacuaaagc

SEQ ID NO: 3457 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaacgaaugtgautaugaaua

SEQ ID NO: 3458 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccutggaagatuagaaucca

SEQ ID NO: 3459 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgucaguucataaaccugga

SEQ ID NO: 3460 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuataaguuccacaauacuccc

SEQ ID NO: 3461 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauctcgauucagagtcauccuc

SEQ ID NO: 3462 - RNA, 23 nt, Artificial Sequence
  source: /note="Description of Artificial Sequence: Synthetic oligonucleotide"
uguaccgucuaacacaauuucag

SEQ ID NO: 3463 - RNA, 23 nt, Artificial Sequence
  source: /note="Description of Artificial Sequence: Synthetic oligonucleotide"
uaaggaaugcaauccgccaaaga

SEQ ID NO: 3464 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacggagaaatgagauggaggc

SEQ ID NO: 3465 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgguacagctctuccuagacu

SEQ ID NO: 3466 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcggatgggacutagagaaggg

SEQ ID NO: 3467 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaucatuggutctcgacuaaag

SEQ ID NO: 3468 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaaacgaaugugatuaugaau

SEQ ID NO: 3469 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaautaacccgtaacugaacc

SEQ ID NO: 3470 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagcuaucugtcgagacagucg

SEQ ID NO: 3471 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugugacgaacatacuccguaaaa

SEQ ID NO: 3472 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcaatagaaagtatguugcug

SEQ ID NO: 3473 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccacgtuaagtgcucggaguca

SEQ ID NO: 3474 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcacaacgagactgaauugccu

SEQ ID NO: 3475 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccgagtucaucatgaaggcauu

SEQ ID NO: 3476 - RNA, 23 nt, Artificial Sequence
  source: /note="Description of Artificial Sequence: Synthetic oligonucleotide"
ugcacacguguguagcuguugac

SEQ ID NO: 3477 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucgcaguuctgtcagcgucac

SEQ ID NO: 3478 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacatutcguaaacaagucagca

SEQ ID NO: 3479 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucaaacaaacgaatgugauua

SEQ ID NO: 3480 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtaauuaacccgtaacugaa

SEQ ID NO: 3481 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauutaacacuccaagggcuuca

SEQ ID NO: 3482 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagtugacugggaaaucagaac

SEQ ID NO: 3483 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacautccagactugaagaugu

SEQ ID NO: 3484 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgagacugaatugccuggauga

SEQ ID NO: 3485 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaagcaaggatgtcgaccaugc

SEQ ID NO: 3486 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuccgaguucatcaugaaggc

SEQ ID NO: 3487 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaaactgaguacgacuggucca

SEQ ID NO: 3488 - RNA, 23 nt, Artificial Sequence
  source: /note="Description of Artificial Sequence: Synthetic oligonucleotide"
ucuucgcaguucugucagcguca

SEQ ID NO: 3489 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacautucguaaacaagucagc

SEQ ID NO: 3490 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utauaacaagaggtucaaacaaa

SEQ ID NO: 3491 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaauaaacacctgaucugaau

SEQ ID NO: 3492 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguatutaacacuccaagggcuu

SEQ ID NO: 3493 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgagaaagaacaataucuuca

SEQ ID NO: 3494 - RNA, 23 nt, Artificial Sequence
  source: /note="Description of Artificial Sequence: Synthetic oligonucleotide"
uccggaacauuccagacuugaag

SEQ ID NO: 3495 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgagacugaautgccuggaug

SEQ ID NO: 3496 - RNA, 23 nt, Artificial Sequence
  source: /note="Description of Artificial Sequence: Synthetic oligonucleotide"
ucgacaagcaaggaugucgacca

SEQ ID NO: 3497 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuuaagcauggagctagcaggc

SEQ ID NO: 3498 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcaaacugagtacgacuggucc

SEQ ID NO: 3499 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggactgacutucuccuuuccu

SEQ ID NO: 3500 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcatagaaagagtuacguuaaa

SEQ ID NO: 3501 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuataacaagaggutcaaacaa

SEQ ID NO: 3502 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtutcaauacaaagccaaua

SEQ ID NO: 3503 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacuccguaaaagcatgucuacc

SEQ ID NO: 3504 - RNA, 23 nt, Artificial Sequence
  source: /note="Description of Artificial Sequence: Synthetic oligonucleotide"
uauacgagaaagaacaauaucuu

SEQ ID NO: 3505 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccggaacautccagacuugaa

SEQ ID NO: 3506 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacgagacugaatugccuggau

SEQ ID NO: 3507 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactaagugagucutgcauggu

SEQ ID NO: 3508 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcutaagcauggagcuagcagg

SEQ ID NO: 3509 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucaaacugaguacgacugguc

SEQ ID NO: 3510 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggatuagggucugaaguucuac

SEQ ID NO: 3511 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauacutuacacgggcauagaaa

SEQ ID NO: 3512 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuuauaacaagaggtucaaaca

SEQ ID NO: 3513 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utugaatgauagcgutcauaaga

SEQ ID NO: 3514 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauactccguaaaagcaugucu

SEQ ID NO: 3515 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugaatacgagaaagaacaaua

SEQ ID NO: 3516 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggacuaaguaactutgugcugg

SEQ ID NO: 3517 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaacgagacugaautgccugga

SEQ ID NO: 3518 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggacuaagugagtctugcaugg

SEQ ID NO: 3519 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaucautcaactugctccaguag

SEQ ID NO: 3520 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuucaaacugagtacgacuggu

SEQ ID NO: 3521 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utccgatgacutugutcaugaug

SEQ ID NO: 3522 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauactuuacacgggcauagaa

SEQ ID NO: 3523 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguguacugututaaagcuuuu

SEQ ID NO: 3524 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucugtutugaatgauagcguuca

SEQ ID NO: 3525 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacgaacauactccgtaaaagca

SEQ ID NO: 3526 - RNA, 23 nt, Artificial Sequence
  source: /note="Description of Artificial Sequence: Synthetic oligonucleotide"
uccugaauacgagaaagaacaau

SEQ ID NO: 3527 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaagtcagaaucctccucuuc

SEQ ID NO: 3528 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacaacgagactgaatugccugg

SEQ ID NO: 3529 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucggactcacugutuccagugac

SEQ ID NO: 3530 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacguguguagctgtugacaag

SEQ ID NO: 3531 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccucugauaatgcucagcuucc

SEQ ID NO: 3532 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucguaaacaagtcagcagccggu

SEQ ID NO: 3533 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utacaacggaaaugucagcgggu

SEQ ID NO: 3534 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaacccguaactgaaccagcugc

SEQ ID NO: 3535 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugucgagacagtcgctuccacuu

SEQ ID NO: 3536 - RNA, 23 nt, Artificial Sequence
  source: /note="Description of Artificial Sequence: Synthetic oligonucleotide"
ugacgaacauacuccguaaaagc

SEQ ID NO: 3537 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguaauagaaacctugaaaaugu

SEQ ID NO: 3538 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utucguacuautucucuauugca

SEQ ID NO: 3539 - RNA, 23 nt, Artificial Sequence
  source: /note="Description of Artificial Sequence: Synthetic oligonucleotide"
ucacaacgagacugaauugccug

SEQ ID NO: 3540 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggaatccgatucaccagcucu

SEQ ID NO: 3541 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uacacgtguguagcuguugacaa

SEQ ID NO: 3542 - RNA, 23 nt, Artificial Sequence
  source: /note="Description of Artificial Sequence: Synthetic oligonucleotide"
ucgucacauacaucagcucaaac

SEQ ID NO: 3543 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utcgtaaacaagucagcagccgg

SEQ ID NO: 3544 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaccaagccacatgacagucgc

SEQ ID NO: 3545 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaatuaacccguaacugaacca

SEQ ID NO: 3546 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagctatcugucgagacagucgc

SEQ ID NO: 3547 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utgacgaacauactccguaaaag

SEQ ID NO: 3548 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccagutguaatagaaaccuuga

SEQ ID NO: 3549 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacgutaagugctcggagucau

SEQ ID NO: 3550 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucaggaauccgautcaccagcuc

SEQ ID NO: 3551 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucacacgugugtagctguugaca

SEQ ID NO: 3552 - RNA, 23 nt, Artificial Sequence
  source: /note="Description of Artificial Sequence: Synthetic oligonucleotide"
uagcgucacauacaucagcucaa

SEQ ID NO: 3553 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utuucgtaaacaagucagcagcc

SEQ ID NO: 3554 - RNA, 23 nt, Artificial Sequence
  source: /note="Description of Artificial Sequence: Synthetic oligonucleotide"
auuucuccgucagcacaauaacc

SEQ ID NO: 3555 - RNA, 23 nt, Artificial Sequence
  source: /note="Description of Artificial Sequence: Synthetic oligonucleotide"
guuuguguucaacaauuguugaa

SEQ ID NO: 3556 - RNA, 23 nt, Artificial Sequence
  source: /note="Description of Artificial Sequence: Synthetic oligonucleotide"
gcgacugucauguggcuugguuu

SEQ ID NO: 3557 - RNA, 21 nt, Artificial Sequence
  source: /note="Description of Artificial Sequence: Synthetic oligonucleotide"
ccgcucagguucugcuuuuaa

SEQ ID NO: 3558 - RNA, 21 nt, Artificial Sequence
  source: /note="Description of Artificial Sequence: Synthetic oligonucleotide"
cucagguucugcuuuuaccua

SEQ ID NO: 3559 - RNA, 21 nt, Artificial Sequence
  source: /note="Description of Artificial Sequence: Synthetic oligonucleotide"
gccgcucagguucugcuuuua

SEQ ID NO: 3560 - RNA, 21 nt, Artificial Sequence
  source: /note="Description of Artificial Sequence: Synthetic oligonucleotide"
aaagcugaugaaggccuucga

SEQ ID NO: 3561 - RNA, 21 nt, Artificial Sequence
  source: /note="Description of Artificial Sequence: Synthetic oligonucleotide"
ucccucaaguccuuccagcaa

SEQ ID NO: 3562 - RNA, 21 nt, Artificial Sequence
  source: /note="Description of Artificial Sequence: Synthetic oligonucleotide"
cgcucagguucugcuuuuaca

SEQ ID NO: 3563 - RNA, 21 nt, Artificial Sequence
  source: /note="Description of Artificial Sequence: Synthetic oligonucleotide"
cugaugaaggccuucgaguca

SEQ ID NO: 3564 - RNA, 21 nt, Artificial Sequence
  source: /note="Description of Artificial Sequence: Synthetic oligonucleotide"
acccuggaaaagcugaugaaa

SEQ ID NO: 3565 - RNA, 21 nt, Artificial Sequence
  source: /note="Description of Artificial Sequence: Synthetic oligonucleotide"
cgagucccucaaguccuucca

SEQ ID NO: 3566 - RNA, 21 nt, Artificial Sequence
  source: /note="Description of Artificial Sequence: Synthetic oligonucleotide"
uggaaaagcugaugaaggcca

SEQ ID NO: 3567 - RNA, 21 nt, Artificial Sequence
  source: /note="Description of Artificial Sequence: Synthetic oligonucleotide"
ccuucgagucccucaagucca

SEQ ID NO: 3568 - RNA, 21 nt, Artificial Sequence
  source: /note="Description of Artificial Sequence: Synthetic oligonucleotide"
acggccgcucagguucugcua

SEQ ID NO: 3569 - RNA, 21 nt, Artificial Sequence
  source: /note="Description of Artificial Sequence: Synthetic oligonucleotide"
cuggaaaagcugaugaaggca

SEQ ID NO: 3570 - RNA, 21 nt, Artificial Sequence
  source: /note="Description of Artificial Sequence: Synthetic oligonucleotide"
gccuucgagucccucaaguca

SEQ ID NO: 3571 - RNA, 21 nt, Artificial Sequence
  source: /note="Description of Artificial Sequence: Synthetic oligonucleotide"
gccgcucagguucugcuuuua

SEQ ID NO: 3572 - RNA, 21 nt, Artificial Sequence
  source: /note="Description of Artificial Sequence: Synthetic oligonucleotide"
gcucagguucugcuuuuacca

SEQ ID NO: 3573 - RNA, 21 nt, Artificial Sequence
  source: /note="Description of Artificial Sequence: Synthetic oligonucleotide"
cagguucugcuuuuaccugca

SEQ ID NO: 3574 - RNA, 21 nt, Artificial Sequence
  source: /note="Description of Artificial Sequence: Synthetic oligonucleotide"
ccagagccccauucauugcca

SEQ ID NO: 3575 - RNA, 21 nt, Artificial Sequence
  source: /note="Description of Artificial Sequence: Synthetic oligonucleotide"
uccaagauggacggccgcuca

SEQ ID NO: 3576 - RNA, 21 nt, Artificial Sequence
  source: /note="Description of Artificial Sequence: Synthetic oligonucleotide"
cgcucagguucugcuuuuaca

SEQ ID NO: 3577 - RNA, 21 nt, Artificial Sequence
  source: /note="Description of Artificial Sequence: Synthetic oligonucleotide"
gcgacccuggaaaagcugaua

SEQ ID NO: 3578 - RNA, 21 nt, Artificial Sequence
  source: /note="Description of Artificial Sequence: Synthetic oligonucleotide"
gcucagguucugcuuuuacca

SEQ ID NO: 3579 - RNA, 21 nt, Artificial Sequence
  source: /note="Description of Artificial Sequence: Synthetic oligonucleotide"
ccauggcgacccuggaaaaga

SEQ ID NO: 3580 - RNA, 21 nt, Artificial Sequence
  source: /note="Description of Artificial Sequence: Synthetic oligonucleotide"
cagguucugcuuuuaccugca

SEQ ID NO: 3581 - RNA, 21 nt, Artificial Sequence
  source: /note="Description of Artificial Sequence: Synthetic oligonucleotide"
cuucgagucccucaaguccua

SEQ ID NO: 3582 - RNA, 21 nt, Artificial Sequence
  source: /note="Description of Artificial Sequence: Synthetic oligonucleotide"
gagucccucaaguccuuccaa

SEQ ID NO: 3583 - RNA, 21 nt, Artificial Sequence
  source: /note="Description of Artificial Sequence: Synthetic oligonucleotide"
cggccgcucagguucugcuua

SEQ ID NO: 3584 - RNA, 21 nt, Artificial Sequence
  source: /note="Description of Artificial Sequence: Synthetic oligonucleotide"
cucagguucugcuuuuaccua

SEQ ID NO: 3585 - RNA, 21 nt, Artificial Sequence
  source: /note="Description of Artificial Sequence: Synthetic oligonucleotide"
ccgcucagguucugcuuuuaa

SEQ ID NO: 3586 - RNA, 21 nt, Artificial Sequence
  source: /note="Description of Artificial Sequence: Synthetic oligonucleotide"
ggacggccgcucagguucuga

SEQ ID NO: 3587 - RNA, 21 nt, Artificial Sequence
  source: /note="Description of Artificial Sequence: Synthetic oligonucleotide"
ugaugaaggccuucgagucca

SEQ ID NO: 3588 - RNA, 21 nt, Artificial Sequence
  source: /note="Description of Artificial Sequence: Synthetic oligonucleotide"
uggacggccgcucagguucua

SEQ ID NO: 3589 - RNA, 21 nt, Artificial Sequence
  source: /note="Description of Artificial Sequence: Synthetic oligonucleotide"
ucagguucugcuuuuaccuga

SEQ ID NO: 3590 - RNA, 21 nt, Artificial Sequence
  source: /note="Description of Artificial Sequence: Synthetic oligonucleotide"
gaugaaggccuucgaguccca

SEQ ID NO: 3591 - RNA, 21 nt, Artificial Sequence
  source: /note="Description of Artificial Sequence: Synthetic oligonucleotide"
cgacccuggaaaagcugauga

SEQ ID NO: 3592 - RNA, 21 nt, Artificial Sequence
  source: /note="Description of Artificial Sequence: Synthetic oligonucleotide"
uggacggccgcucagguucua

SEQ ID NO: 3593 - RNA, 21 nt, Artificial Sequence
  source: /note="Description of Artificial Sequence: Synthetic oligonucleotide"
gacccuggaaaagcugaugaa

SEQ ID NO: 3594 - RNA, 21 nt, Artificial Sequence
  source: /note="Description of Artificial Sequence: Synthetic oligonucleotide"
aaggccuucgagucccucaaa

SEQ ID NO: 3595 - RNA, 21 nt, Artificial Sequence
  source: /note="Description of Artificial Sequence: Synthetic oligonucleotide"
ucgagucccucaaguccuuca

SEQ ID NO: 3596 - RNA, 21 nt, Artificial Sequence
  source: /note="Description of Artificial Sequence: Synthetic oligonucleotide"
auggcgacccuggaaaagcua

SEQ ID NO: 3597 - RNA, 21 nt, Artificial Sequence
  source: /note="Description of Artificial Sequence: Synthetic oligonucleotide"
ccauucauugccccggugcua

SEQ ID NO: 3598 - RNA, 21 nt, Artificial Sequence
  source: /note="Description of Artificial Sequence: Synthetic oligonucleotide"
uucgagucccucaaguccuua

SEQ ID NO: 3599 - RNA, 21 nt, Artificial Sequence
  source: /note="Description of Artificial Sequence: Synthetic oligonucleotide"
gacggguccaagauggacgga

SEQ ID NO: 3600 - RNA, 21 nt, Artificial Sequence
  source: /note="Description of Artificial Sequence: Synthetic oligonucleotide"
uccaagauggacggccgcuca

SEQ ID NO: 3601 - RNA, 21 nt, Artificial Sequence
  source: /note="Description of Artificial Sequence: Synthetic oligonucleotide"
ggacggguccaagauggacga

SEQ ID NO: 3602 - RNA, 21 nt, Artificial Sequence
  source: /note="Description of Artificial Sequence: Synthetic oligonucleotide"
acggguccaagauggacggca

SEQ ID NO: 3603 - RNA, 21 nt, Artificial Sequence
  source: /note="Description of Artificial Sequence: Synthetic oligonucleotide"
augaaggccuucgagucccua

SEQ ID NO: 3604 - RNA, 21 nt, Artificial Sequence
  source: /note="Description of Artificial Sequence: Synthetic oligonucleotide"
ccuccggggacugccgugcca

SEQ ID NO: 3605 - RNA, 21 nt, Artificial Sequence
  source: /note="Description of Artificial Sequence: Synthetic oligonucleotide"
gccauggcgacccuggaaaaa

SEQ ID NO: 3606 - RNA, 21 nt, Artificial Sequence
  source: /note="Description of Artificial Sequence: Synthetic oligonucleotide"
aagauggacggccgcucagga

SEQ ID NO: 3607 - RNA, 21 nt, Artificial Sequence
  source: /note="Description of Artificial Sequence: Synthetic oligonucleotide"
aagauggacggccgcucagga

SEQ ID NO: 3608 - RNA, 21 nt, Artificial Sequence
  source: /note="Description of Artificial Sequence: Synthetic oligonucleotide"
uucugcuuuuaccugcggcca

SEQ ID NO: 3609 - RNA, 21 nt, Artificial Sequence
  source: /note="Description of Artificial Sequence: Synthetic oligonucleotide"
ccagagccccauucauugcca

SEQ ID NO: 3610 - RNA, 21 nt, Artificial Sequence
  source: /note="Description of Artificial Sequence: Synthetic oligonucleotide"
agauggacggccgcucaggua

SEQ ID NO: 3611 - RNA, 21 nt, Artificial Sequence
  source: /note="Description of Artificial Sequence: Synthetic oligonucleotide"
agucccucaaguccuuccaga

SEQ ID NO: 3612 - RNA, 21 nt, Artificial Sequence
  source: /note="Description of Artificial Sequence: Synthetic oligonucleotide"
gguucugcuuuuaccugcgga

SEQ ID NO: 3613 - RNA, 21 nt, Artificial Sequence
  source: /note="Description of Artificial Sequence: Synthetic oligonucleotide"
ggacggccgcucagguucuga

SEQ ID NO: 3614 - RNA, 21 nt, Artificial Sequence
  source: /note="Description of Artificial Sequence: Synthetic oligonucleotide"
ggccuucgagucccucaagua

SEQ ID NO: 3615 - RNA, 21 nt, Artificial Sequence
  source: /note="Description of Artificial Sequence: Synthetic oligonucleotide"
ugaaggccuucgagucccuca

SEQ ID NO: 3616 - RNA, 21 nt, Artificial Sequence
  source: /note="Description of Artificial Sequence: Synthetic oligonucleotide"
cccagagccccauucauugca

SEQ ID NO: 3617 - RNA, 21 nt, Artificial Sequence
  source: /note="Description of Artificial Sequence: Synthetic oligonucleotide"
acggguccaagauggacggca

SEQ ID NO: 3618 - RNA, 21 nt, Artificial Sequence
  source: /note="Description of Artificial Sequence: Synthetic oligonucleotide"
cuccggggacugccgugccga

SEQ ID NO: 3619 - RNA, 21 nt, Artificial Sequence
  source: /note="Description of Artificial Sequence: Synthetic oligonucleotide"
ccgugccgggcgggagaccga

SEQ ID NO: 3620 - RNA, 21 nt, Artificial Sequence
  source: /note="Description of Artificial Sequence: Synthetic oligonucleotide"
gucccucaaguccuuccagca

SEQ ID NO: 3621 - RNA, 21 nt, Artificial Sequence
  source: /note="Description of Artificial Sequence: Synthetic oligonucleotide"
gacggguccaagauggacgga

SEQ ID NO: 3622 - RNA, 21 nt, Artificial Sequence
  source: /note="Description of Artificial Sequence: Synthetic oligonucleotide"
agauggacggccgcucaggua

SEQ ID NO: 3623 - RNA, 21 nt, Artificial Sequence
  source: /note="Description of Artificial Sequence: Synthetic oligonucleotide"
ggacggguccaagauggacga

SEQ ID NO: 3624 - RNA, 21 nt, Artificial Sequence
  source: /note="Description of Artificial Sequence: Synthetic oligonucleotide"
gguucugcuuuuaccugcgga

SEQ ID NO: 3625 - RNA, 21 nt, Artificial Sequence
  source: /note="Description of Artificial Sequence: Synthetic oligonucleotide"
accgccauggcgacccuggaa

SEQ ID NO: 3626 - RNA, 21 nt, Artificial Sequence
  source: /note="Description of Artificial Sequence: Synthetic oligonucleotide"
cgaggccuccggggacugcca

SEQ ID NO: 3627 - RNA, 21 nt, Artificial Sequence
  source: /note="Description of Artificial Sequence: Synthetic oligonucleotide"
aagcugaugaaggccuucgaa

SEQ ID NO: 3628 - RNA, 21 nt, Artificial Sequence
  source: /note="Description of Artificial Sequence: Synthetic oligonucleotide"
cgggacggguccaagauggaa

SEQ ID NO: 3629 - RNA, 21 nt, Artificial Sequence
  source: /note="Description of Artificial Sequence: Synthetic oligonucleotide"
cagagccccauucauugccca

SEQ ID NO: 3630 - RNA, 21 nt, Artificial Sequence
  source: /note="Description of Artificial Sequence: Synthetic oligonucleotide"
ugcugagcggcgccgcgagua

SEQ ID NO: 3631 - RNA, 21 nt, Artificial Sequence
  source: /note="Description of Artificial Sequence: Synthetic oligonucleotide"
cgggacggguccaagauggaa

SEQ ID NO: 3632 - RNA, 21 nt, Artificial Sequence
  source: /note="Description of Artificial Sequence: Synthetic oligonucleotide"
cccgaggccuccggggacuga

SEQ ID NO: 3633 - RNA, 21 nt, Artificial Sequence
  source: /note="Description of Artificial Sequence: Synthetic oligonucleotide"
cagagccccauucauugccca

SEQ ID NO: 3634 - RNA, 21 nt, Artificial Sequence
  source: /note="Description of Artificial Sequence: Synthetic oligonucleotide"
uggcgacccuggaaaagcuga

SEQ ID NO: 3635 - RNA, 21 nt, Artificial Sequence
  source: /note="Description of Artificial Sequence: Synthetic oligonucleotide"
gaggccuccggggacugccga

SEQ ID NO: 3636 - RNA, 21 nt, Artificial Sequence
  source: /note="Description of Artificial Sequence: Synthetic oligonucleotide"
acggccgcucagguucugcua

SEQ ID NO: 3637 - RNA, 21 nt, Artificial Sequence
  source: /note="Description of Artificial Sequence: Synthetic oligonucleotide"
ccgaggccuccggggacugca

SEQ ID NO: 3638 - RNA, 21 nt, Artificial Sequence
  source: /note="Description of Artificial Sequence: Synthetic oligonucleotide"
uucugcuuuuaccugcggcca

SEQ ID NO: 3639 - RNA, 21 nt, Artificial Sequence
  source: /note="Description of Artificial Sequence: Synthetic oligonucleotide"
cggccgcucagguucugcuua

SEQ ID NO: 3640 - RNA, 21 nt, Artificial Sequence
  source: /note="Description of Artificial Sequence: Synthetic oligonucleotide"
gcugagcggcgccgcgaguca

SEQ ID NO: 3641 - RNA, 21 nt, Artificial Sequence
  source: /note="Description of Artificial Sequence: Synthetic oligonucleotide"
gcccgaggccuccggggacua

SEQ ID NO: 3642 - RNA, 21 nt, Artificial Sequence
  source: /note="Description of Artificial Sequence: Synthetic oligonucleotide"
gagucggcccgaggccuccga

SEQ ID NO: 3643 - RNA, 21 nt, Artificial Sequence
  source: /note="Description of Artificial Sequence: Synthetic oligonucleotide"
cccagagccccauucauugca

SEQ ID NO: 3644 - RNA, 23 nt, Artificial Sequence
  source: /note="Description of Artificial Sequence: Synthetic oligonucleotide"
uuaaaagcagaaccugagcggcc

SEQ ID NO: 3645 - RNA, 23 nt, Artificial Sequence
  source: /note="Description of Artificial Sequence: Synthetic oligonucleotide"
uagguaaaagcagaaccugagcg

SEQ ID NO: 3646 - RNA, 23 nt, Artificial Sequence
  source: /note="Description of Artificial Sequence: Synthetic oligonucleotide"
uaaaagcagaaccugagcggccg

SEQ ID NO: 3647 - RNA, 23 nt, Artificial Sequence
  source: /note="Description of Artificial Sequence: Synthetic oligonucleotide"
ucgaaggccuucaucagcuuuuc

SEQ ID NO: 3648 - RNA, 23 nt, Artificial Sequence
  source: /note="Description of Artificial Sequence: Synthetic oligonucleotide"
uugcuggaaggacuugagggacu

SEQ ID NO: 3649 - RNA, 23 nt, Artificial Sequence
  source: /note="Description of Artificial Sequence: Synthetic oligonucleotide"
uguaaaagcagaaccugagcggc

SEQ ID NO: 3650 - RNA, 23 nt, Artificial Sequence
  source: /note="Description of Artificial Sequence: Synthetic oligonucleotide"
ugacucgaaggccuucaucagcu

SEQ ID NO: 3651 - RNA, 23 nt, Artificial Sequence
  source: /note="Description of Artificial Sequence: Synthetic oligonucleotide"
uuucaucagcuuuuccagggucg

SEQ ID NO: 3652 - RNA, 23 nt, Artificial Sequence
  source: /note="Description of Artificial Sequence: Synthetic oligonucleotide"
uggaaggacuugagggacucgaa

SEQ ID NO: 3653 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggccutcaucagcuuuuccagg

SEQ ID NO: 3654 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggacutgagggacucgaaggcc

SEQ ID NO: 3655 - RNA, 23 nt, Artificial Sequence
  source: /note="Description of Artificial Sequence: Synthetic oligonucleotide"
uagcagaaccugagcggccgucc

SEQ ID NO: 3656 - RNA, 23 nt, Artificial Sequence
  source: /note="Description of Artificial Sequence: Synthetic oligonucleotide"
ugccuucaucagcuuuuccaggg

SEQ ID NO: 3657 - RNA, 23 nt, Artificial Sequence
  source: /note="Description of Artificial Sequence: Synthetic oligonucleotide"
ugacuugagggacucgaaggccu

SEQ ID NO: 3658 - RNA, 23 nt, Artificial Sequence
  source: /note="Description of Artificial Sequence: Synthetic oligonucleotide"
uaaaagcagaaccugagcggccg

SEQ ID NO: 3659 - RNA, 23 nt, Artificial Sequence
  source: /note="Description of Artificial Sequence: Synthetic oligonucleotide"
ugguaaaagcagaaccugagcgg

SEQ ID NO: 3660 - RNA, 23 nt, Artificial Sequence
  source: /note="Description of Artificial Sequence: Synthetic oligonucleotide"
ugcagguaaaagcagaaccugag

SEQ ID NO: 3661 - RNA, 23 nt, Artificial Sequence
  source: /note="Description of Artificial Sequence: Synthetic oligonucleotide"
uggcaaugaauggggcucugggc

SEQ ID NO: 3662 - RNA, 23 nt, Artificial Sequence
  source: /note="Description of Artificial Sequence: Synthetic oligonucleotide"
ugagcggccguccaucuuggacc

SEQ ID NO: 3663 - RNA, 23 nt, Artificial Sequence
  source: /note="Description of Artificial Sequence: Synthetic oligonucleotide"
uguaaaagcagaaccugagcggc

SEQ ID NO: 3664 - RNA, 23 nt, Artificial Sequence
  source: /note="Description of Artificial Sequence: Synthetic oligonucleotide"
uaucagcuuuuccagggucgcca

SEQ ID NO: 3665 - RNA, 23 nt, Artificial Sequence
  source: /note="Description of Artificial Sequence: Synthetic oligonucleotide"
ugguaaaagcagaaccugagcgg

SEQ ID NO: 3666 - RNA, 23 nt, Artificial Sequence
  source: /note="Description of Artificial Sequence: Synthetic oligonucleotide"
ucuuuuccagggucgccauggcg

SEQ ID NO: 3667 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaggtaaaagcagaaccugag

SEQ ID NO: 3668 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggactugagggacucgaaggc

SEQ ID NO: 3669 - RNA, 23 nt, Artificial Sequence
  source: /note="Description of Artificial Sequence: Synthetic oligonucleotide"
uuggaaggacuugagggacucga

SEQ ID NO: 3670 - RNA, 23 nt, Artificial Sequence
  source: /note="Description of Artificial Sequence: Synthetic oligonucleotide"
uaagcagaaccugagcggccguc

SEQ ID NO: 3671 - RNA, 23 nt, Artificial Sequence
  source: /note="Description of Artificial Sequence: Synthetic oligonucleotide"
uagguaaaagcagaaccugagcg

SEQ ID NO: 3672 - RNA, 23 nt, Artificial Sequence
  source: /note="Description of Artificial Sequence: Synthetic oligonucleotide"
uuaaaagcagaaccugagcggcc

SEQ ID NO: 3673 - RNA, 23 nt, Artificial Sequence
  source: /note="Description of Artificial Sequence: Synthetic oligonucleotide"
ucagaaccugagcggccguccau

SEQ ID NO: 3674 - RNA, 23 nt, Artificial Sequence
  source: /note="Description of Artificial Sequence: Synthetic oligonucleotide"
uggacucgaaggccuucaucagc

SEQ ID NO: 3675 - RNA, 23 nt, Artificial Sequence
  source: /note="Description of Artificial Sequence: Synthetic oligonucleotide"
uagaaccugagcggccguccauc

SEQ ID NO: 3676 - RNA, 23 nt, Artificial Sequence
  source: /note="Description of Artificial Sequence: Synthetic oligonucleotide"
ucagguaaaagcagaaccugagc

SEQ ID NO: 3677 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugggactcgaaggccuucaucag

SEQ ID NO: 3678 - RNA, 23 nt, Artificial Sequence
  source: /note="Description of Artificial Sequence: Synthetic oligonucleotide"
ucaucagcuuuuccagggucgcc

SEQ ID NO: 3679 - RNA, 23 nt, Artificial Sequence
  source: /note="Description of Artificial Sequence: Synthetic oligonucleotide"
uagaaccugagcggccguccauc

SEQ ID NO: 3680 - RNA, 23 nt, Artificial Sequence
  source: /note="Description of Artificial Sequence: Synthetic oligonucleotide"
uucaucagcuuuuccagggucgc

SEQ ID NO: 3681 - RNA, 23 nt, Artificial Sequence
  source: /note="Description of Artificial Sequence: Synthetic oligonucleotide"
uuugagggacucgaaggccuuca

SEQ ID NO: 3682 - RNA, 23 nt, Artificial Sequence
  source: /note="Description of Artificial Sequence: Synthetic oligonucleotide"
ugaaggacuugagggacucgaag

SEQ ID NO: 3683 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuutuccagggucgccaugg

SEQ ID NO: 3684 - RNA, 23 nt, Artificial Sequence
  source: /note="Description of Artificial Sequence: Synthetic oligonucleotide"
uagcaccggggcaaugaaugggg

SEQ ID NO: 3685 - RNA, 23 nt, Artificial Sequence
  source: /note="Description of Artificial Sequence: Synthetic oligonucleotide"
uaaggacuugagggacucgaagg

SEQ ID NO: 3686 - RNA, 23 nt, Artificial Sequence
  source: /note="Description of Artificial Sequence: Synthetic oligonucleotide"
uccguccaucuuggacccguccc

SEQ ID NO: 3687 - RNA, 23 nt, Artificial Sequence
  source: /note="Description of Artificial Sequence: Synthetic oligonucleotide"
ugagcggccguccaucuuggacc

SEQ ID NO: 3688 - RNA, 23 nt, Artificial Sequence
  source: /note="Description of Artificial Sequence: Synthetic oligonucleotide"
ucguccaucuuggacccgucccg

SEQ ID NO: 3689 - RNA, 23 nt, Artificial Sequence
  source: /note="Description of Artificial Sequence: Synthetic oligonucleotide"
ugccguccaucuuggacccgucc

SEQ ID NO: 3690 - RNA, 23 nt, Artificial Sequence
  source: /note="Description of Artificial Sequence: Synthetic oligonucleotide"
uagggacucgaaggccuucauca

SEQ ID NO: 3691 - RNA, 23 nt, Artificial Sequence
  source: /note="Description of Artificial Sequence: Synthetic oligonucleotide"
uggcacggcaguccccggaggcc

SEQ ID NO: 3692 - RNA, 23 nt, Artificial Sequence
  source: /note="Description of Artificial Sequence: Synthetic oligonucleotide"
uuuuuccagggucgccauggcgg

SEQ ID NO: 3693 - RNA, 23 nt, Artificial Sequence
  source: /note="Description of Artificial Sequence: Synthetic oligonucleotide"
uccugagcggccguccaucuugg

SEQ ID NO: 3694 - RNA, 23 nt, Artificial Sequence
  source: /note="Description of Artificial Sequence: Synthetic oligonucleotide"
uccugagcggccguccaucuugg

SEQ ID NO: 3695 - RNA, 23 nt, Artificial Sequence
  source: /note="Description of Artificial Sequence: Synthetic oligonucleotide"
uggccgcagguaaaagcagaacc

SEQ ID NO: 3696 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcaatgaauggggcucugggc

SEQ ID NO: 3697 - RNA, 23 nt, Artificial Sequence
  source: /note="Description of Artificial Sequence: Synthetic oligonucleotide"
uaccugagcggccguccaucuug

SEQ ID NO: 3698 - RNA, 23 nt, Artificial Sequence
  source: /note="Description of Artificial Sequence: Synthetic oligonucleotide"
ucuggaaggacuugagggacucg

SEQ ID NO: 3699 - RNA, 23 nt, Artificial Sequence
  source: /note="Description of Artificial Sequence: Synthetic oligonucleotide"
uccgcagguaaaagcagaaccug

SEQ ID NO: 3700 - RNA, 23 nt, Artificial Sequence
  source: /note="Description of Artificial Sequence: Synthetic oligonucleotide"
ucagaaccugagcggccguccau

SEQ ID NO: 3701 - RNA, 23 nt, Artificial Sequence
  source: /note="Description of Artificial Sequence: Synthetic oligonucleotide"
uacuugagggacucgaaggccuu

SEQ ID NO: 3702 - RNA, 23 nt, Artificial Sequence
  source: /note="Description of Artificial Sequence: Synthetic oligonucleotide"
ugagggacucgaaggccuucauc

SEQ ID NO: 3703 - RNA, 23 nt, Artificial Sequence
  source: /note="Description of Artificial Sequence: Synthetic oligonucleotide"
ugcaaugaauggggcucugggcc

SEQ ID NO: 3704 - RNA, 23 nt, Artificial Sequence
  source: /note="Description of Artificial Sequence: Synthetic oligonucleotide"
ugccguccaucuuggacccgucc

SEQ ID NO: 3705 - RNA, 23 nt, Artificial Sequence
  source: /note="Description of Artificial Sequence: Synthetic oligonucleotide"
ucggcacggcaguccccggaggc

SEQ ID NO: 3706 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgguctcccgcccggcacggca

SEQ ID NO: 3707 - RNA, 23 nt, Artificial Sequence
  source: /note="Description of Artificial Sequence: Synthetic oligonucleotide"
ugcuggaaggacuugagggacuc

SEQ ID NO: 3708 - RNA, 23 nt, Artificial Sequence
  source: /note="Description of Artificial Sequence: Synthetic oligonucleotide"
uccguccaucuuggacccguccc

SEQ ID NO: 3709 - RNA, 23 nt, Artificial Sequence
  source: /note="Description of Artificial Sequence: Synthetic oligonucleotide"
uaccugagcggccguccaucuug

SEQ ID NO: 3710 - RNA, 23 nt, Artificial Sequence
  source: /note="Description of Artificial Sequence: Synthetic oligonucleotide"
ucguccaucuuggacccgucccg

SEQ ID NO: 3711 - RNA, 23 nt, Artificial Sequence
  source: /note="Description of Artificial Sequence: Synthetic oligonucleotide"
uccgcagguaaaagcagaaccug

SEQ ID NO: 3712 - RNA, 23 nt, Artificial Sequence
  source: /note="Description of Artificial Sequence: Synthetic oligonucleotide"
uuccagggucgccauggcggucu

SEQ ID NO: 3713 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcagtccccggaggccucggg

SEQ ID NO: 3714 - RNA, 23 nt, Artificial Sequence
  source: /note="Description of Artificial Sequence: Synthetic oligonucleotide"
uucgaaggccuucaucagcuuuu

SEQ ID NO: 3715 - RNA, 23 nt, Artificial Sequence
  source: /note="Description of Artificial Sequence: Synthetic oligonucleotide"
uuccaucuuggacccgucccggc

SEQ ID NO: 3716 - RNA, 23 nt, Artificial Sequence
  source: /note="Description of Artificial Sequence: Synthetic oligonucleotide"
ugggcaaugaauggggcucuggg

SEQ ID NO: 3717 - RNA, 23 nt, Artificial Sequence
  source: /note="Description of Artificial Sequence: Synthetic oligonucleotide"
uacucgcggcgccgcucagcacc

SEQ ID NO: 3718 - RNA, 23 nt, Artificial Sequence
  source: /note="Description of Artificial Sequence: Synthetic oligonucleotide"
uuccaucuuggacccgucccggc

SEQ ID NO: 3719 - RNA, 23 nt, Artificial Sequence
  source: /note="Description of Artificial Sequence: Synthetic oligonucleotide"
ucaguccccggaggccucgggcc

SEQ ID NO: 3720 - RNA, 23 nt, Artificial Sequence
  source: /note="Description of Artificial Sequence: Synthetic oligonucleotide"
ugggcaaugaauggggcucuggg

SEQ ID NO: 3721 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagcutuuccagggucgccaug

SEQ ID NO: 3722 - RNA, 23 nt, Artificial Sequence
  source: /note="Description of Artificial Sequence: Synthetic oligonucleotide"
ucggcaguccccggaggccucgg

SEQ ID NO: 3723 - RNA, 23 nt, Artificial Sequence
  source: /note="Description of Artificial Sequence: Synthetic oligonucleotide"
uagcagaaccugagcggccgucc

SEQ ID NO: 3724 - RNA, 23 nt, Artificial Sequence
  source: /note="Description of Artificial Sequence: Synthetic oligonucleotide"
ugcaguccccggaggccucgggc

SEQ ID NO: 3725 - RNA, 23 nt, Artificial Sequence
  source: /note="Description of Artificial Sequence: Synthetic oligonucleotide"
uggccgcagguaaaagcagaacc

SEQ ID NO: 3726 - RNA, 23 nt, Artificial Sequence
  source: /note="Description of Artificial Sequence: Synthetic oligonucleotide"
uaagcagaaccugagcggccguc

SEQ ID NO: 3727 - RNA, 23 nt, Artificial Sequence
  source: /note="Description of Artificial Sequence: Synthetic oligonucleotide"
ugacucgcggcgccgcucagcac

SEQ ID NO: 3728 - RNA, 23 nt, Artificial Sequence
  source: /note="Description of Artificial Sequence: Synthetic oligonucleotide"
uaguccccggaggccucgggccg

SEQ ID NO: 3729 - RNA, 23 nt, Artificial Sequence
  source: /note="Description of Artificial Sequence: Synthetic oligonucleotide"
ucggaggccucgggccgacucgc

SEQ ID NO: 3730 - RNA, 23 nt, Artificial Sequence
  source: /note="Description of Artificial Sequence: Synthetic oligonucleotide"
ugcaaugaauggggcucugggcc

SEQ ID NO: 3731 - RNA, 23 nt, Artificial Sequence
  source: /note="Description of Artificial Sequence: Synthetic oligonucleotide"
ggccgcucagguucugcuuuuac

SEQ ID NO: 3732 - RNA, 23 nt, Artificial Sequence
  source: /note="Description of Artificial Sequence: Synthetic oligonucleotide"
cgcucagguucugcuuuuaccug

SEQ ID NO: 3733 - RNA, 23 nt, Artificial Sequence
  source: /note="Description of Artificial Sequence: Synthetic oligonucleotide"
cggccgcucagguucugcuuuua

SEQ ID NO: 3734 - RNA, 23 nt, Artificial Sequence
  source: /note="Description of Artificial Sequence: Synthetic oligonucleotide"
gaaaagcugaugaaggccuucga

SEQ ID NO: 3735 - RNA, 23 nt, Artificial Sequence
  source: /note="Description of Artificial Sequence: Synthetic oligonucleotide"
agucccucaaguccuuccagcag

SEQ ID NO: 3736 - RNA, 23 nt, Artificial Sequence
  source: /note="Description of Artificial Sequence: Synthetic oligonucleotide"
gccgcucagguucugcuuuuacc

SEQ ID NO: 3737 - RNA, 23 nt, Artificial Sequence
  source: /note="Description of Artificial Sequence: Synthetic oligonucleotide"
agcugaugaaggccuucgagucc

SEQ ID NO: 3738 - RNA, 23 nt, Artificial Sequence
  source: /note="Description of Artificial Sequence: Synthetic oligonucleotide"
cgacccuggaaaagcugaugaag

SEQ ID NO: 3739 - RNA, 23 nt, Artificial Sequence
  source: /note="Description of Artificial Sequence: Synthetic oligonucleotide"
uucgagucccucaaguccuucca

SEQ ID NO: 3740 - RNA, 23 nt, Artificial Sequence
  source: /note="Description of Artificial Sequence: Synthetic oligonucleotide"
ccuggaaaagcugaugaaggccu

SEQ ID NO: 3741 - RNA, 23 nt, Artificial Sequence
  source: /note="Description of Artificial Sequence: Synthetic oligonucleotide"
ggccuucgagucccucaaguccu

SEQ ID NO: 3742 - RNA, 23 nt, Artificial Sequence
  source: /note="Description of Artificial Sequence: Synthetic oligonucleotide"
ggacggccgcucagguucugcuu

SEQ ID NO: 3743 - RNA, 23 nt, Artificial Sequence
  source: /note="Description of Artificial Sequence: Synthetic oligonucleotide"
cccuggaaaagcugaugaaggcc

SEQ ID NO: 3744 - RNA, 23 nt, Artificial Sequence
  source: /note="Description of Artificial Sequence: Synthetic oligonucleotide"
aggccuucgagucccucaagucc

SEQ ID NO: 3745 - RNA, 23 nt, Artificial Sequence
  source: /note="Description of Artificial Sequence: Synthetic oligonucleotide"
ccgcucagguucugcuuuuaccu

SEQ ID NO: 3746 - RNA, 23 nt, Artificial Sequence
  source: /note="Description of Artificial Sequence: Synthetic oligonucleotide"
cucagguucugcuuuuaccugcg

SEQ ID NO: 3747 - RNA, 23 nt, Artificial Sequence
  source: /note="Description of Artificial Sequence: Synthetic oligonucleotide"
gcccagagccccauucauugccc

SEQ ID NO: 3748 - RNA, 23 nt, Artificial Sequence
  source: /note="Description of Artificial Sequence: Synthetic oligonucleotide"
gguccaagauggacggccgcuca

SEQ ID NO: 3749 - RNA, 23 nt, Artificial Sequence
  source: /note="Description of Artificial Sequence: Synthetic oligonucleotide"
uggcgacccuggaaaagcugaug

SEQ ID NO: 3750 - RNA, 23 nt, Artificial Sequence
  source: /note="Description of Artificial Sequence: Synthetic oligonucleotide"
cgccauggcgacccuggaaaagc

SEQ ID NO: 3751 - RNA, 23 nt, Artificial Sequence
  source: /note="Description of Artificial Sequence: Synthetic oligonucleotide"
gccuucgagucccucaaguccuu

SEQ ID NO: 3752 - RNA, 23 nt, Artificial Sequence
  source: /note="Description of Artificial Sequence: Synthetic oligonucleotide"
ucgagucccucaaguccuuccag

SEQ ID NO: 3753 - RNA, 23 nt, Artificial Sequence
  source: /note="Description of Artificial Sequence: Synthetic oligonucleotide"
gacggccgcucagguucugcuuu

SEQ ID NO: 3754 - RNA, 23 nt, Artificial Sequence
  source: /note="Description of Artificial Sequence: Synthetic oligonucleotide"
auggacggccgcucagguucugc

SEQ ID NO: 3755 - RNA, 23 nt, Artificial Sequence
  source: /note="Description of Artificial Sequence: Synthetic oligonucleotide"
gcugaugaaggccuucgaguccc

SEQ ID NO: 3756 - RNA, 23 nt, Artificial Sequence
  source: /note="Description of Artificial Sequence: Synthetic oligonucleotide"
gauggacggccgcucagguucug

SEQ ID NO: 3757 - RNA, 23 nt, Artificial Sequence
  source: /note="Description of Artificial Sequence: Synthetic oligonucleotide"
gcucagguucugcuuuuaccugc

SEQ ID NO: 3758 - RNA, 23 nt, Artificial Sequence
  source: /note="Description of Artificial Sequence: Synthetic oligonucleotide"
cugaugaaggccuucgagucccu

SEQ ID NO: 3759 - RNA, 23 nt, Artificial Sequence
  source: /note="Description of Artificial Sequence: Synthetic oligonucleotide"
ggcgacccuggaaaagcugauga

SEQ ID NO: 3760 - RNA, 23 nt, Artificial Sequence
  source: /note="Description of Artificial Sequence: Synthetic oligonucleotide"
gcgacccuggaaaagcugaugaa

SEQ ID NO: 3761 - RNA, 23 nt, Artificial Sequence
  source: /note="Description of Artificial Sequence: Synthetic oligonucleotide"
ugaaggccuucgagucccucaag

SEQ ID NO: 3762 - RNA, 23 nt, Artificial Sequence
  source: /note="Description of Artificial Sequence: Synthetic oligonucleotide"
cuucgagucccucaaguccuucc

SEQ ID NO: 3763 - RNA, 23 nt, Artificial Sequence
  source: /note="Description of Artificial Sequence: Synthetic oligonucleotide"
ccauggcgacccuggaaaagcug

SEQ ID NO: 3764 - RNA, 23 nt, Artificial Sequence
  source: /note="Description of Artificial Sequence: Synthetic oligonucleotide"
ccccauucauugccccggugcug

SEQ ID NO: 3765 - RNA, 23 nt, Artificial Sequence
  source: /note="Description of Artificial Sequence: Synthetic oligonucleotide"
ccuucgagucccucaaguccuuc

SEQ ID NO: 3766 - RNA, 23 nt, Artificial Sequence
  source: /note="Description of Artificial Sequence: Synthetic oligonucleotide"
gggacggguccaagauggacggc

SEQ ID NO: 3767 - RNA, 23 nt, Artificial Sequence
  source: /note="Description of Artificial Sequence: Synthetic oligonucleotide"
cgggacggguccaagauggacgg

SEQ ID NO: 3768 - RNA, 23 nt, Artificial Sequence
  source: /note="Description of Artificial Sequence: Synthetic oligonucleotide"
ggacggguccaagauggacggcc

SEQ ID NO: 3769 - RNA, 23 nt, Artificial Sequence
  source: /note="Description of Artificial Sequence: Synthetic oligonucleotide"
ugaugaaggccuucgagucccuc

SEQ ID NO: 3770 - RNA, 23 nt, Artificial Sequence
  source: /note="Description of Artificial Sequence: Synthetic oligonucleotide"
ggccuccggggacugccgugccg

SEQ ID NO: 3771 - RNA, 23 nt, Artificial Sequence
  source: /note="Description of Artificial Sequence: Synthetic oligonucleotide"
ccgccauggcgacccuggaaaag

SEQ ID NO: 3772 - RNA, 23 nt, Artificial Sequence
  source: /note="Description of Artificial Sequence: Synthetic oligonucleotide"
ccaagauggacggccgcucaggu

SEQ ID NO: 3773 - RNA, 23 nt, Artificial Sequence
  source: /note="Description of Artificial Sequence: Synthetic oligonucleotide"
gguucugcuuuuaccugcggccc

SEQ ID NO: 3774 - RNA, 23 nt, Artificial Sequence
  source: /note="Description of Artificial Sequence: Synthetic oligonucleotide"
caagauggacggccgcucagguu

SEQ ID NO: 3775 - RNA, 23 nt, Artificial Sequence
  source: /note="Description of Artificial Sequence: Synthetic oligonucleotide"
cgagucccucaaguccuuccagc

SEQ ID NO: 3776 - RNA, 23 nt, Artificial Sequence
  source: /note="Description of Artificial Sequence: Synthetic oligonucleotide"
cagguucugcuuuuaccugcggc

SEQ ID NO: 3777 - RNA, 23 nt, Artificial Sequence
  source: /note="Description of Artificial Sequence: Synthetic oligonucleotide"
aaggccuucgagucccucaaguc

SEQ ID NO: 3778 - RNA, 23 nt, Artificial Sequence
  source: /note="Description of Artificial Sequence: Synthetic oligonucleotide"
gaugaaggccuucgagucccuca

SEQ ID NO: 3779 - RNA, 23 nt, Artificial Sequence
  source: /note="Description of Artificial Sequence: Synthetic oligonucleotide"
ggcccagagccccauucauugcc

SEQ ID NO: 3780 - RNA, 23 nt, Artificial Sequence
  source: /note="Description of Artificial Sequence: Synthetic oligonucleotide"
gccuccggggacugccgugccgg

SEQ ID NO: 3781 - RNA, 23 nt, Artificial Sequence
  source: /note="Description of Artificial Sequence: Synthetic oligonucleotide"
ugccgugccgggcgggagaccgc

SEQ ID NO: 3782 - RNA, 23 nt, Artificial Sequence
  source: /note="Description of Artificial Sequence: Synthetic oligonucleotide"
gagucccucaaguccuuccagca

SEQ ID NO: 3783 - RNA, 23 nt, Artificial Sequence
  source: /note="Description of Artificial Sequence: Synthetic oligonucleotide"
agaccgccauggcgacccuggaa

SEQ ID NO: 3784 - RNA, 23 nt, Artificial Sequence
  source: /note="Description of Artificial Sequence: Synthetic oligonucleotide"
cccgaggccuccggggacugccg

SEQ ID NO: 3785 - RNA, 23 nt, Artificial Sequence
  source: /note="Description of Artificial Sequence: Synthetic oligonucleotide"
aaaagcugaugaaggccuucgag

SEQ ID NO: 3786 - RNA, 23 nt, Artificial Sequence
  source: /note="Description of Artificial Sequence: Synthetic oligonucleotide"
gccgggacggguccaagauggac

SEQ ID NO: 3787 - RNA, 23 nt, Artificial Sequence
  source: /note="Description of Artificial Sequence: Synthetic oligonucleotide"
cccagagccccauucauugcccc

SEQ ID NO: 3788 - RNA, 23 nt, Artificial Sequence
  source: /note="Description of Artificial Sequence: Synthetic oligonucleotide"
ggugcugagcggcgccgcgaguc

SEQ ID NO: 3789 - RNA, 23 nt, Artificial Sequence
  source: /note="Description of Artificial Sequence: Synthetic oligonucleotide"
ggcccgaggccuccggggacugc

SEQ ID NO: 3790 - RNA, 23 nt, Artificial Sequence
  source: /note="Description of Artificial Sequence: Synthetic oligonucleotide"
cauggcgacccuggaaaagcuga

SEQ ID NO: 3791 - RNA, 23 nt, Artificial Sequence
  source: /note="Description of Artificial Sequence: Synthetic oligonucleotide"
ccgaggccuccggggacugccgu

SEQ ID NO: 3792 - RNA, 23 nt, Artificial Sequence
  source: /note="Description of Artificial Sequence: Synthetic oligonucleotide"
gcccgaggccuccggggacugcc

SEQ ID NO: 3793 - RNA, 23 nt, Artificial Sequence
  source: /note="Description of Artificial Sequence: Synthetic oligonucleotide"
gugcugagcggcgccgcgagucg

SEQ ID NO: 3794 - RNA, 23 nt, Artificial Sequence
  source: /note="Description of Artificial Sequence: Synthetic oligonucleotide"
cggcccgaggccuccggggacug

SEQ ID NO: 3795 - RNA, 23 nt, Artificial Sequence
  source: /note="Description of Artificial Sequence: Synthetic oligonucleotide"
gcgagucggcccgaggccuccgg

SEQ ID NO: 3796 - RNA, 21 nt, Artificial Sequence
  source: /note="Description of Artificial Sequence: Synthetic oligonucleotide"
ccgcucagguucugcuuuuaa

SEQ ID NO: 3797 - RNA, 21 nt, Artificial Sequence
  source: /note="Description of Artificial Sequence: Synthetic oligonucleotide"
cucagguucugcuuuuaccua

SEQ ID NO: 3798 - RNA, 21 nt, Artificial Sequence
  source: /note="Description of Artificial Sequence: Synthetic oligonucleotide"
gccgcucagguucugcuuuua

SEQ ID NO: 3799 - RNA, 21 nt, Artificial Sequence
  source: /note="Description of Artificial Sequence: Synthetic oligonucleotide"
aaagcugaugaaggccuucga

SEQ ID NO: 3800 - RNA, 21 nt, Artificial Sequence
  source: /note="Description of Artificial Sequence: Synthetic oligonucleotide"
ucccucaaguccuuccagcaa

SEQ ID NO: 3801 - RNA, 21 nt, Artificial Sequence
  source: /note="Description of Artificial Sequence: Synthetic oligonucleotide"
cgcucagguucugcuuuuaca

SEQ ID NO: 3802 - RNA, 21 nt, Artificial Sequence
  source: /note="Description of Artificial Sequence: Synthetic oligonucleotide"
cugaugaaggccuucgaguca

SEQ ID NO: 3803 - RNA, 21 nt, Artificial Sequence
  source: /note="Description of Artificial Sequence: Synthetic oligonucleotide"
acccuggaaaagcugaugaaa

SEQ ID NO: 3804 - RNA, 21 nt, Artificial Sequence
  source: /note="Description of Artificial Sequence: Synthetic oligonucleotide"
cgagucccucaaguccuucca

SEQ ID NO: 3805 - RNA, 21 nt, Artificial Sequence
  source: /note="Description of Artificial Sequence: Synthetic oligonucleotide"
uggaaaagcugaugaaggcca

SEQ ID NO: 3806 - RNA, 21 nt, Artificial Sequence
  source: /note="Description of Artificial Sequence: Synthetic oligonucleotide"
ccuucgagucccucaagucca

SEQ ID NO: 3807 - RNA, 21 nt, Artificial Sequence
  source: /note="Description of Artificial Sequence: Synthetic oligonucleotide"
acggccgcucagguucugcua

SEQ ID NO: 3808 - RNA, 21 nt, Artificial Sequence
  source: /note="Description of Artificial Sequence: Synthetic oligonucleotide"
cuggaaaagcugaugaaggca

SEQ ID NO: 3809 - RNA, 21 nt, Artificial Sequence
  source: /note="Description of Artificial Sequence: Synthetic oligonucleotide"
gccuucgagucccucaaguca

SEQ ID NO: 3810 - RNA, 21 nt, Artificial Sequence
  source: /note="Description of Artificial Sequence: Synthetic oligonucleotide"
gcucagguucugcuuuuacca

SEQ ID NO: 3811 - RNA, 21 nt, Artificial Sequence
  source: /note="Description of Artificial Sequence: Synthetic oligonucleotide"
cagguucugcuuuuaccugca

SEQ ID NO: 3812 - RNA, 21 nt, Artificial Sequence
  source: /note="Description of Artificial Sequence: Synthetic oligonucleotide"
ccagagccccauucauugcca

SEQ ID NO: 3813 - RNA, 21 nt, Artificial Sequence
  source: /note="Description of Artificial Sequence: Synthetic oligonucleotide"
uccaagauggacggccgcuca

SEQ ID NO: 3814 - RNA, 21 nt, Artificial Sequence
  source: /note="Description of Artificial Sequence: Synthetic oligonucleotide"
gcgacccuggaaaagcugaua

SEQ ID NO: 3815 - RNA, 21 nt, Artificial Sequence
  source: /note="Description of Artificial Sequence: Synthetic oligonucleotide"
ccauggcgacccuggaaaaga

SEQ ID NO: 3816 - RNA, 21 nt, Artificial Sequence
  source: /note="Description of Artificial Sequence: Synthetic oligonucleotide"
cuucgagucccucaaguccua

SEQ ID NO: 3817 - RNA, 21 nt, Artificial Sequence
  source: /note="Description of Artificial Sequence: Synthetic oligonucleotide"
gagucccucaaguccuuccaa

SEQ ID NO: 3818 - RNA, 21 nt, Artificial Sequence
  source: /note="Description of Artificial Sequence: Synthetic oligonucleotide"
cggccgcucagguucugcuua

SEQ ID NO: 3819 - RNA, 21 nt, Artificial Sequence
  source: /note="Description of Artificial Sequence: Synthetic oligonucleotide"
ggacggccgcucagguucuga

SEQ ID NO: 3820 - RNA, 21 nt, Artificial Sequence
  source: /note="Description of Artificial Sequence: Synthetic oligonucleotide"
ugaugaaggccuucgagucca

SEQ ID NO: 3821 - RNA, 21 nt, Artificial Sequence
  source: /note="Description of Artificial Sequence: Synthetic oligonucleotide"
uggacggccgcucagguucua

SEQ ID NO: 3822 - RNA, 21 nt, Artificial Sequence
  source: /note="Description of Artificial Sequence: Synthetic oligonucleotide"
ucagguucugcuuuuaccuga

SEQ ID NO: 3823 - RNA, 21 nt, Artificial Sequence
  source: /note="Description of Artificial Sequence: Synthetic oligonucleotide"
gaugaaggccuucgaguccca

SEQ ID NO: 3824 - RNA, 21 nt, Artificial Sequence
  source: /note="Description of Artificial Sequence: Synthetic oligonucleotide"
cgacccuggaaaagcugauga

SEQ ID NO: 3825 - RNA, 21 nt, Artificial Sequence
  source: /note="Description of Artificial Sequence: Synthetic oligonucleotide"
gacccuggaaaagcugaugaa

SEQ ID NO: 3826 - RNA, 21 nt, Artificial Sequence
  source: /note="Description of Artificial Sequence: Synthetic oligonucleotide"
aaggccuucgagucccucaaa

SEQ ID NO: 3827 - RNA, 21 nt, Artificial Sequence
  source: /note="Description of Artificial Sequence: Synthetic oligonucleotide"
ucgagucccucaaguccuuca

SEQ ID NO: 3828 - RNA, 21 nt, Artificial Sequence
  source: /note="Description of Artificial Sequence: Synthetic oligonucleotide"
auggcgacccuggaaaagcua

SEQ ID NO: 3829 - RNA, 21 nt, Artificial Sequence
  source: /note="Description of Artificial Sequence: Synthetic oligonucleotide"
ccauucauugccccggugcua

SEQ ID NO: 3830 - RNA, 21 nt, Artificial Sequence
  source: /note="Description of Artificial Sequence: Synthetic oligonucleotide"
uucgagucccucaaguccuua

SEQ ID NO: 3831 - RNA, 21 nt, Artificial Sequence
  source: /note="Description of Artificial Sequence: Synthetic oligonucleotide"
gacggguccaagauggacgga

SEQ ID NO: 3832 - RNA, 21 nt, Artificial Sequence
  source: /note="Description of Artificial Sequence: Synthetic oligonucleotide"
ggacggguccaagauggacga

SEQ ID NO: 3833 - RNA, 21 nt, Artificial Sequence
  source: /note="Description of Artificial Sequence: Synthetic oligonucleotide"
acggguccaagauggacggca

SEQ ID NO: 3834 - RNA, 21 nt, Artificial Sequence
  source: /note="Description of Artificial Sequence: Synthetic oligonucleotide"
augaaggccuucgagucccua

SEQ ID NO: 3835 - RNA, 21 nt, Artificial Sequence
  source: /note="Description of Artificial Sequence: Synthetic oligonucleotide"
ccuccggggacugccgugcca

SEQ ID NO: 3836 - RNA, 21 nt, Artificial Sequence
  source: /note="Description of Artificial Sequence: Synthetic oligonucleotide"
gccauggcgacccuggaaaaa

SEQ ID NO: 3837 - RNA, 21 nt, Artificial Sequence
  source: /note="Description of Artificial Sequence: Synthetic oligonucleotide"
aagauggacggccgcucagga

SEQ ID NO: 3838 - RNA, 21 nt, Artificial Sequence
  source: /note="Description of Artificial Sequence: Synthetic oligonucleotide"
uucugcuuuuaccugcggcca

SEQ ID NO: 3839 - RNA, 21 nt, Artificial Sequence
  source: /note="Description of Artificial Sequence: Synthetic oligonucleotide"
agauggacggccgcucaggua

SEQ ID NO: 3840 - RNA, 21 nt, Artificial Sequence
  source: /note="Description of Artificial Sequence: Synthetic oligonucleotide"
agucccucaaguccuuccaga

SEQ ID NO: 3841 - RNA, 21 nt, Artificial Sequence
  source: /note="Description of Artificial Sequence: Synthetic oligonucleotide"
gguucugcuuuuaccugcgga

SEQ ID NO: 3842 - RNA, 21 nt, Artificial Sequence
  source: /note="Description of Artificial Sequence: Synthetic oligonucleotide"
ggccuucgagucccucaagua

SEQ ID NO: 3843 - RNA, 21 nt, Artificial Sequence
  source: /note="Description of Artificial Sequence: Synthetic oligonucleotide"
ugaaggccuucgagucccuca

SEQ ID NO: 3844 - RNA, 21 nt, Artificial Sequence
  source: /note="Description of Artificial Sequence: Synthetic oligonucleotide"
cccagagccccauucauugca

SEQ ID NO: 3845 - RNA, 21 nt, Artificial Sequence
  source: /note="Description of Artificial Sequence: Synthetic oligonucleotide"
cuccggggacugccgugccga

SEQ ID NO: 3846 - RNA, 21 nt, Artificial Sequence
  source: /note="Description of Artificial Sequence: Synthetic oligonucleotide"
ccgugccgggcgggagaccga

SEQ ID NO: 3847 - RNA, 21 nt, Artificial Sequence
  source: /note="Description of Artificial Sequence: Synthetic oligonucleotide"
gucccucaaguccuuccagca

SEQ ID NO: 3848 - RNA, 21 nt, Artificial Sequence
  source: /note="Description of Artificial Sequence: Synthetic oligonucleotide"
accgccauggcgacccuggaa

SEQ ID NO: 3849 - RNA, 21 nt, Artificial Sequence
  source: /note="Description of Artificial Sequence: Synthetic oligonucleotide"
cgaggccuccggggacugcca

SEQ ID NO: 3850 - RNA, 21 nt, Artificial Sequence
  source: /note="Description of Artificial Sequence: Synthetic oligonucleotide"
aagcugaugaaggccuucgaa

SEQ ID NO: 3851 - RNA, 21 nt, Artificial Sequence
  source: /note="Description of Artificial Sequence: Synthetic oligonucleotide"
cgggacggguccaagauggaa

SEQ ID NO: 3852 - RNA, 21 nt, Artificial Sequence
  source: /note="Description of Artificial Sequence: Synthetic oligonucleotide"
cagagccccauucauugccca

SEQ ID NO: 3853 - RNA, 21 nt, Artificial Sequence
  source: /note="Description of Artificial Sequence: Synthetic oligonucleotide"
ugcugagcggcgccgcgagua

SEQ ID NO: 3854 - RNA, 21 nt, Artificial Sequence
  source: /note="Description of Artificial Sequence: Synthetic oligonucleotide"
cccgaggccuccggggacuga

SEQ ID NO: 3855 - RNA, 21 nt, Artificial Sequence
  source: /note="Description of Artificial Sequence: Synthetic oligonucleotide"
uggcgacccuggaaaagcuga

SEQ ID NO: 3856 - RNA, 21 nt, Artificial Sequence
  source: /note="Description of Artificial Sequence: Synthetic oligonucleotide"
gaggccuccggggacugccga

SEQ ID NO: 3857 - RNA, 21 nt, Artificial Sequence
  source: /note="Description of Artificial Sequence: Synthetic oligonucleotide"
ccgaggccuccggggacugca

SEQ ID NO: 3858 - RNA, 21 nt, Artificial Sequence
  source: /note="Description of Artificial Sequence: Synthetic oligonucleotide"
gcugagcggcgccgcgaguca

SEQ ID NO: 3859 - RNA, 21 nt, Artificial Sequence
  source: /note="Description of Artificial Sequence: Synthetic oligonucleotide"
gcccgaggccuccggggacua

SEQ ID NO: 3860 - RNA, 21 nt, Artificial Sequence
  source: /note="Description of Artificial Sequence: Synthetic oligonucleotide"
gagucggcccgaggccuccga

SEQ ID NO: 3861 - RNA, 23 nt, Artificial Sequence
  source: /note="Description of Artificial Sequence: Synthetic oligonucleotide"
uuaaaagcagaaccugagcggcc

SEQ ID NO: 3862 - RNA, 23 nt, Artificial Sequence
  source: /note="Description of Artificial Sequence: Synthetic oligonucleotide"
uagguaaaagcagaaccugagcg

SEQ ID NO: 3863 - RNA, 23 nt, Artificial Sequence
  source: /note="Description of Artificial Sequence: Synthetic oligonucleotide"
uaaaagcagaaccugagcggccg

SEQ ID NO: 3864 - RNA, 23 nt, Artificial Sequence
  source: /note="Description of Artificial Sequence: Synthetic oligonucleotide"
ucgaaggccuucaucagcuuuuc

SEQ ID NO: 3865 - RNA, 23 nt, Artificial Sequence
  source: /note="Description of Artificial Sequence: Synthetic oligonucleotide"
uugcuggaaggacuugagggacu

SEQ ID NO: 3866 - RNA, 23 nt, Artificial Sequence
  source: /note="Description of Artificial Sequence: Synthetic oligonucleotide"
uguaaaagcagaaccugagcggc

SEQ ID NO: 3867 - RNA, 23 nt, Artificial Sequence
  source: /note="Description of Artificial Sequence: Synthetic oligonucleotide"
ugacucgaaggccuucaucagcu

SEQ ID NO: 3868 - RNA, 23 nt, Artificial Sequence
  source: /note="Description of Artificial Sequence: Synthetic oligonucleotide"
uuucaucagcuuuuccagggucg

SEQ ID NO: 3869 - RNA, 23 nt, Artificial Sequence
  source: /note="Description of Artificial Sequence: Synthetic oligonucleotide"
uggaaggacuugagggacucgaa

SEQ ID NO: 3870 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggccutcaucagcuuuuccagg

SEQ ID NO: 3871 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggacutgagggacucgaaggcc

SEQ ID NO: 3872 - RNA, 23 nt, Artificial Sequence
  source: /note="Description of Artificial Sequence: Synthetic oligonucleotide"
uagcagaaccugagcggccgucc

SEQ ID NO: 3873 - RNA, 23 nt, Artificial Sequence
  source: /note="Description of Artificial Sequence: Synthetic oligonucleotide"
ugccuucaucagcuuuuccaggg

SEQ ID NO: 3874 - RNA, 23 nt, Artificial Sequence
  source: /note="Description of Artificial Sequence: Synthetic oligonucleotide"
ugacuugagggacucgaaggccu

SEQ ID NO: 3875 - RNA, 23 nt, Artificial Sequence
  source: /note="Description of Artificial Sequence: Synthetic oligonucleotide"
ugguaaaagcagaaccugagcgg

SEQ ID NO: 3876 - RNA, 23 nt, Artificial Sequence
  source: /note="Description of Artificial Sequence: Synthetic oligonucleotide"
ugcagguaaaagcagaaccugag

SEQ ID NO: 3877 - RNA, 23 nt, Artificial Sequence
  source: /note="Description of Artificial Sequence: Synthetic oligonucleotide"
uggcaaugaauggggcucugggc

SEQ ID NO: 3878 - RNA, 23 nt, Artificial Sequence
  source: /note="Description of Artificial Sequence: Synthetic oligonucleotide"
ugagcggccguccaucuuggacc

SEQ ID NO: 3879 - RNA, 23 nt, Artificial Sequence
  source: /note="Description of Artificial Sequence: Synthetic oligonucleotide"
uaucagcuuuuccagggucgcca

SEQ ID NO: 3880 - RNA, 23 nt, Artificial Sequence
  source: /note="Description of Artificial Sequence: Synthetic oligonucleotide"
ucuuuuccagggucgccauggcg

SEQ ID NO: 3881 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugcaggtaaaagcagaaccugag

SEQ ID NO: 3882 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggactugagggacucgaaggc

SEQ ID NO: 3883 - RNA, 23 nt, Artificial Sequence
  source: /note="Description of Artificial Sequence: Synthetic oligonucleotide"
uuggaaggacuugagggacucga

SEQ ID NO: 3884 - RNA, 23 nt, Artificial Sequence
  source: /note="Description of Artificial Sequence: Synthetic oligonucleotide"
uaagcagaaccugagcggccguc

SEQ ID NO: 3885 - RNA, 23 nt, Artificial Sequence
  source: /note="Description of Artificial Sequence: Synthetic oligonucleotide"
ucagaaccugagcggccguccau

SEQ ID NO: 3886 - RNA, 23 nt, Artificial Sequence
  source: /note="Description of Artificial Sequence: Synthetic oligonucleotide"
uggacucgaaggccuucaucagc

SEQ ID NO: 3887 - RNA, 23 nt, Artificial Sequence
  source: /note="Description of Artificial Sequence: Synthetic oligonucleotide"
uagaaccugagcggccguccauc

SEQ ID NO: 3888 - RNA, 23 nt, Artificial Sequence
  source: /note="Description of Artificial Sequence: Synthetic oligonucleotide"
ucagguaaaagcagaaccugagc

SEQ ID NO: 3889 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugggactcgaaggccuucaucag

SEQ ID NO: 3890 - RNA, 23 nt, Artificial Sequence
  source: /note="Description of Artificial Sequence: Synthetic oligonucleotide"
ucaucagcuuuuccagggucgcc

SEQ ID NO: 3891 - RNA, 23 nt, Artificial Sequence
  source: /note="Description of Artificial Sequence: Synthetic oligonucleotide"
uucaucagcuuuuccagggucgc

SEQ ID NO: 3892 - RNA, 23 nt, Artificial Sequence
  source: /note="Description of Artificial Sequence: Synthetic oligonucleotide"
uuugagggacucgaaggccuuca

SEQ ID NO: 3893 - RNA, 23 nt, Artificial Sequence
  source: /note="Description of Artificial Sequence: Synthetic oligonucleotide"
ugaaggacuugagggacucgaag

SEQ ID NO: 3894 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uagcuutuccagggucgccaugg

SEQ ID NO: 3895 - RNA, 23 nt, Artificial Sequence
  source: /note="Description of Artificial Sequence: Synthetic oligonucleotide"
uagcaccggggcaaugaaugggg

SEQ ID NO: 3896 - RNA, 23 nt, Artificial Sequence
  source: /note="Description of Artificial Sequence: Synthetic oligonucleotide"
uaaggacuugagggacucgaagg

SEQ ID NO: 3897 - RNA, 23 nt, Artificial Sequence
  source: /note="Description of Artificial Sequence: Synthetic oligonucleotide"
uccguccaucuuggacccguccc

SEQ ID NO: 3898 - RNA, 23 nt, Artificial Sequence
  source: /note="Description of Artificial Sequence: Synthetic oligonucleotide"
ucguccaucuuggacccgucccg

SEQ ID NO: 3899 - RNA, 23 nt, Artificial Sequence
  source: /note="Description of Artificial Sequence: Synthetic oligonucleotide"
ugccguccaucuuggacccgucc

SEQ ID NO: 3900 - RNA, 23 nt, Artificial Sequence
  source: /note="Description of Artificial Sequence: Synthetic oligonucleotide"
uagggacucgaaggccuucauca

SEQ ID NO: 3901 - RNA, 23 nt, Artificial Sequence
  source: /note="Description of Artificial Sequence: Synthetic oligonucleotide"
uggcacggcaguccccggaggcc

SEQ ID NO: 3902 - RNA, 23 nt, Artificial Sequence
  source: /note="Description of Artificial Sequence: Synthetic oligonucleotide"
uuuuuccagggucgccauggcgg

SEQ ID NO: 3903 - RNA, 23 nt, Artificial Sequence
  source: /note="Description of Artificial Sequence: Synthetic oligonucleotide"
uccugagcggccguccaucuugg

SEQ ID NO: 3904 - RNA, 23 nt, Artificial Sequence
  source: /note="Description of Artificial Sequence: Synthetic oligonucleotide"
uggccgcagguaaaagcagaacc

SEQ ID NO: 3905 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcaatgaauggggcucugggc

SEQ ID NO: 3906 - RNA, 23 nt, Artificial Sequence
  source: /note="Description of Artificial Sequence: Synthetic oligonucleotide"
uaccugagcggccguccaucuug

SEQ ID NO: 3907 - RNA, 23 nt, Artificial Sequence
  source: /note="Description of Artificial Sequence: Synthetic oligonucleotide"
ucuggaaggacuugagggacucg

SEQ ID NO: 3908 - RNA, 23 nt, Artificial Sequence
  source: /note="Description of Artificial Sequence: Synthetic oligonucleotide"
uccgcagguaaaagcagaaccug

SEQ ID NO: 3909 - RNA, 23 nt, Artificial Sequence
  source: /note="Description of Artificial Sequence: Synthetic oligonucleotide"
uacuugagggacucgaaggccuu

SEQ ID NO: 3910 - RNA, 23 nt, Artificial Sequence
  source: /note="Description of Artificial Sequence: Synthetic oligonucleotide"
ugagggacucgaaggccuucauc

SEQ ID NO: 3911 - RNA, 23 nt, Artificial Sequence
  source: /note="Description of Artificial Sequence: Synthetic oligonucleotide"
ugcaaugaauggggcucugggcc

SEQ ID NO: 3912 - RNA, 23 nt, Artificial Sequence
  source: /note="Description of Artificial Sequence: Synthetic oligonucleotide"
ucggcacggcaguccccggaggc

SEQ ID NO: 3913 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucgguctcccgcccggcacggca

SEQ ID NO: 3914 - RNA, 23 nt, Artificial Sequence
  source: /note="Description of Artificial Sequence: Synthetic oligonucleotide"
ugcuggaaggacuugagggacuc

SEQ ID NO: 3915 - RNA, 23 nt, Artificial Sequence
  source: /note="Description of Artificial Sequence: Synthetic oligonucleotide"
uuccagggucgccauggcggucu

SEQ ID NO: 3916 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uggcagtccccggaggccucggg

SEQ ID NO: 3917 - RNA, 23 nt, Artificial Sequence
  source: /note="Description of Artificial Sequence: Synthetic oligonucleotide"
uucgaaggccuucaucagcuuuu

SEQ ID NO: 3918 - RNA, 23 nt, Artificial Sequence
  source: /note="Description of Artificial Sequence: Synthetic oligonucleotide"
uuccaucuuggacccgucccggc

SEQ ID NO: 3919 - RNA, 23 nt, Artificial Sequence
  source: /note="Description of Artificial Sequence: Synthetic oligonucleotide"
ugggcaaugaauggggcucuggg

SEQ ID NO: 3920 - RNA, 23 nt, Artificial Sequence
  source: /note="Description of Artificial Sequence: Synthetic oligonucleotide"
uacucgcggcgccgcucagcacc

SEQ ID NO: 3921 - RNA, 23 nt, Artificial Sequence
  source: /note="Description of Artificial Sequence: Synthetic oligonucleotide"
ucaguccccggaggccucgggcc

SEQ ID NO: 3922 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagcutuuccagggucgccaug

SEQ ID NO: 3923 - RNA, 23 nt, Artificial Sequence
  source: /note="Description of Artificial Sequence: Synthetic oligonucleotide"
ucggcaguccccggaggccucgg

SEQ ID NO: 3924 - RNA, 23 nt, Artificial Sequence
  source: /note="Description of Artificial Sequence: Synthetic oligonucleotide"
ugcaguccccggaggccucgggc

SEQ ID NO: 3925 - RNA, 23 nt, Artificial Sequence
  source: /note="Description of Artificial Sequence: Synthetic oligonucleotide"
ugacucgcggcgccgcucagcac

SEQ ID NO: 3926 - RNA, 23 nt, Artificial Sequence
  source: /note="Description of Artificial Sequence: Synthetic oligonucleotide"
uaguccccggaggccucgggccg

SEQ ID NO: 3927 - RNA, 23 nt, Artificial Sequence
  source: /note="Description of Artificial Sequence: Synthetic oligonucleotide"
ucggaggccucgggccgacucgc

SEQ ID NO: 3928 - RNA, 21 nt, Artificial Sequence
  source: /note="Description of Artificial Sequence: Synthetic oligonucleotide"
ugcugagcggcgccgcgagua

SEQ ID NO: 3929 - RNA, 21 nt, Artificial Sequence
  source: /note="Description of Artificial Sequence: Synthetic oligonucleotide"
gcugagcggcgccgcgaguca

SEQ ID NO: 3930 - RNA, 21 nt, Artificial Sequence
  source: /note="Description of Artificial Sequence: Synthetic oligonucleotide"
gagucggcccgaggccuccga

SEQ ID NO: 3931 - RNA, 21 nt, Artificial Sequence
  source: /note="Description of Artificial Sequence: Synthetic oligonucleotide"
agucggcccgaggccuccgga

SEQ ID NO: 3932 - RNA, 21 nt, Artificial Sequence
  source: /note="Description of Artificial Sequence: Synthetic oligonucleotide"
gcccgaggccuccggggacua

SEQ ID NO: 3933 - RNA, 21 nt, Artificial Sequence
  source: /note="Description of Artificial Sequence: Synthetic oligonucleotide"
cccgaggccuccggggacuga

SEQ ID NO: 3934 - RNA, 21 nt, Artificial Sequence
  source: /note="Description of Artificial Sequence: Synthetic oligonucleotide"
ccgaggccuccggggacugca

SEQ ID NO: 3935 - RNA, 21 nt, Artificial Sequence
  source: /note="Description of Artificial Sequence: Synthetic oligonucleotide"
cgaggccuccggggacugcca

SEQ ID NO: 3936 - RNA, 21 nt, Artificial Sequence
  source: /note="Description of Artificial Sequence: Synthetic oligonucleotide"
gaggccuccggggacugccga

SEQ ID NO: 3937 - RNA, 21 nt, Artificial Sequence
  source: /note="Description of Artificial Sequence: Synthetic oligonucleotide"
ccuccggggacugccgugcca

SEQ ID NO: 3938 - RNA, 21 nt, Artificial Sequence
  source: /note="Description of Artificial Sequence: Synthetic oligonucleotide"
cuccggggacugccgugccga

SEQ ID NO: 3939 - RNA, 21 nt, Artificial Sequence
  source: /note="Description of Artificial Sequence: Synthetic oligonucleotide"
ccgugccgggcgggagaccga

SEQ ID NO: 3940 - RNA, 21 nt, Artificial Sequence
  source: /note="Description of Artificial Sequence: Synthetic oligonucleotide"
accgccauggcgacccuggaa

SEQ ID NO: 3941 - RNA, 21 nt, Artificial Sequence
  source: /note="Description of Artificial Sequence: Synthetic oligonucleotide"
gccauggcgacccuggaaaaa

SEQ ID NO: 3942 - RNA, 21 nt, Artificial Sequence
  source: /note="Description of Artificial Sequence: Synthetic oligonucleotide"
ccauggcgacccuggaaaaga

SEQ ID NO: 3943 - RNA, 21 nt, Artificial Sequence
  source: /note="Description of Artificial Sequence: Synthetic oligonucleotide"
auggcgacccuggaaaagcua

SEQ ID NO: 3944 - RNA, 21 nt, Artificial Sequence
  source: /note="Description of Artificial Sequence: Synthetic oligonucleotide"
uggcgacccuggaaaagcuga

SEQ ID NO: 3945 - RNA, 21 nt, Artificial Sequence
  source: /note="Description of Artificial Sequence: Synthetic oligonucleotide"
gcgacccuggaaaagcugaua

SEQ ID NO: 3946 - RNA, 21 nt, Artificial Sequence
  source: /note="Description of Artificial Sequence: Synthetic oligonucleotide"
cgacccuggaaaagcugauga

SEQ ID NO: 3947 - RNA, 21 nt, Artificial Sequence
  source: /note="Description of Artificial Sequence: Synthetic oligonucleotide"
gacccuggaaaagcugaugaa

SEQ ID NO: 3948 - RNA, 21 nt, Artificial Sequence
  source: /note="Description of Artificial Sequence: Synthetic oligonucleotide"
acccuggaaaagcugaugaaa

SEQ ID NO: 3949 - RNA, 21 nt, Artificial Sequence
  source: /note="Description of Artificial Sequence: Synthetic oligonucleotide"
cuggaaaagcugaugaaggca

SEQ ID NO: 3950 - RNA, 21 nt, Artificial Sequence
  source: /note="Description of Artificial Sequence: Synthetic oligonucleotide"
uggaaaagcugaugaaggcca

SEQ ID NO: 3951 - RNA, 21 nt, Artificial Sequence
  source: /note="Description of Artificial Sequence: Synthetic oligonucleotide"
aaagcugaugaaggccuucga

SEQ ID NO: 3952 - RNA, 21 nt, Artificial Sequence
  source: /note="Description of Artificial Sequence: Synthetic oligonucleotide"
aagcugaugaaggccuucgaa

SEQ ID NO: 3953 - RNA, 21 nt, Artificial Sequence
  source: /note="Description of Artificial Sequence: Synthetic oligonucleotide"
cugaugaaggccuucgaguca

SEQ ID NO: 3954 - RNA, 21 nt, Artificial Sequence
  source: /note="Description of Artificial Sequence: Synthetic oligonucleotide"
ugaugaaggccuucgagucca

SEQ ID NO: 3955 - RNA, 21 nt, Artificial Sequence
  source: /note="Description of Artificial Sequence: Synthetic oligonucleotide"
gaugaaggccuucgaguccca

SEQ ID NO: 3956 - RNA, 21 nt, Artificial Sequence
  source: /note="Description of Artificial Sequence: Synthetic oligonucleotide"
augaaggccuucgagucccua

SEQ ID NO: 3957 - RNA, 21 nt, Artificial Sequence
  source: /note="Description of Artificial Sequence: Synthetic oligonucleotide"
ugaaggccuucgagucccuca

SEQ ID NO: 3958 - RNA, 21 nt, Artificial Sequence
  source: /note="Description of Artificial Sequence: Synthetic oligonucleotide"
aaggccuucgagucccucaaa

SEQ ID NO: 3959 - RNA, 21 nt, Artificial Sequence
  source: /note="Description of Artificial Sequence: Synthetic oligonucleotide"
ggccuucgagucccucaagua

SEQ ID NO: 3960 - RNA, 21 nt, Artificial Sequence
  source: /note="Description of Artificial Sequence: Synthetic oligonucleotide"
gccuucgagucccucaaguca

SEQ ID NO: 3961 - RNA, 21 nt, Artificial Sequence
  source: /note="Description of Artificial Sequence: Synthetic oligonucleotide"
ccuucgagucccucaagucca

SEQ ID NO: 3962 - RNA, 21 nt, Artificial Sequence
  source: /note="Description of Artificial Sequence: Synthetic oligonucleotide"
cuucgagucccucaaguccua

SEQ ID NO: 3963 - RNA, 21 nt, Artificial Sequence
  source: /note="Description of Artificial Sequence: Synthetic oligonucleotide"
uucgagucccucaaguccuua

SEQ ID NO: 3964 - RNA, 21 nt, Artificial Sequence
  source: /note="Description of Artificial Sequence: Synthetic oligonucleotide"
ucgagucccucaaguccuuca

SEQ ID NO: 3965 - RNA, 21 nt, Artificial Sequence
  source: /note="Description of Artificial Sequence: Synthetic oligonucleotide"
cgagucccucaaguccuucca

SEQ ID NO: 3966 - RNA, 21 nt, Artificial Sequence
  source: /note="Description of Artificial Sequence: Synthetic oligonucleotide"
gagucccucaaguccuuccaa

SEQ ID NO: 3967 - RNA, 21 nt, Artificial Sequence
  source: /note="Description of Artificial Sequence: Synthetic oligonucleotide"
gucccucaaguccuuccagca

SEQ ID NO: 3968 - RNA, 23 nt, Artificial Sequence
  source: /note="Description of Artificial Sequence: Synthetic oligonucleotide"
uacucgcggcgccgcucagcacc

SEQ ID NO: 3969 - RNA, 23 nt, Artificial Sequence
  source: /note="Description of Artificial Sequence: Synthetic oligonucleotide"
ugacucgcggcgccgcucagcac

SEQ ID NO: 3970 - RNA, 23 nt, Artificial Sequence
  source: /note="Description of Artificial Sequence: Synthetic oligonucleotide"
ucggaggccucgggccgacucgc

SEQ ID NO: 3971 - RNA, 23 nt, Artificial Sequence
  source: /note="Description of Artificial Sequence: Synthetic oligonucleotide"
uccggaggccucgggccgacucg

SEQ ID NO: 3972 - RNA, 23 nt, Artificial Sequence
  source: /note="Description of Artificial Sequence: Synthetic oligonucleotide"
uaguccccggaggccucgggccg

SEQ ID NO: 3973 - RNA, 23 nt, Artificial Sequence
  source: /note="Description of Artificial Sequence: Synthetic oligonucleotide"
ucaguccccggaggccucgggcc

SEQ ID NO: 3974 - RNA, 23 nt, Artificial Sequence
  source: /note="Description of Artificial Sequence: Synthetic oligonucleotide"
ugcaguccccggaggccucgggc

SEQ ID NO: 3975 - RNA, 23 nt, Artificial Sequence
  source: /note="Description of Artificial Sequence: Synthetic oligonucleotide"
uggcaguccccggaggccucggg

SEQ ID NO: 3976 - RNA, 23 nt, Artificial Sequence
  source: /note="Description of Artificial Sequence: Synthetic oligonucleotide"
ucggcaguccccggaggccucgg

SEQ ID NO: 3977 - RNA, 23 nt, Artificial Sequence
  source: /note="Description of Artificial Sequence: Synthetic oligonucleotide"
uggcacggcaguccccggaggcc

SEQ ID NO: 3978 - RNA, 23 nt, Artificial Sequence
  source: /note="Description of Artificial Sequence: Synthetic oligonucleotide"
ucggcacggcaguccccggaggc

SEQ ID NO: 3979 - RNA, 23 nt, Artificial Sequence
  source: /note="Description of Artificial Sequence: Synthetic oligonucleotide"
ucggucucccgcccggcacggca

SEQ ID NO: 3980 - RNA, 23 nt, Artificial Sequence
  source: /note="Description of Artificial Sequence: Synthetic oligonucleotide"
uuccagggucgccauggcggucu

SEQ ID NO: 3981 - RNA, 23 nt, Artificial Sequence
  source: /note="Description of Artificial Sequence: Synthetic oligonucleotide"
uuuuuccagggucgccauggcgg

SEQ ID NO: 3982 - RNA, 23 nt, Artificial Sequence
  source: /note="Description of Artificial Sequence: Synthetic oligonucleotide"
ucuuuuccagggucgccauggcg

SEQ ID NO: 3983 - RNA, 23 nt, Artificial Sequence
  source: /note="Description of Artificial Sequence: Synthetic oligonucleotide"
uagcuuuuccagggucgccaugg

SEQ ID NO: 3984 - RNA, 23 nt, Artificial Sequence
  source: /note="Description of Artificial Sequence: Synthetic oligonucleotide"
ucagcuuuuccagggucgccaug

SEQ ID NO: 3985 - RNA, 23 nt, Artificial Sequence
  source: /note="Description of Artificial Sequence: Synthetic oligonucleotide"
uaucagcuuuuccagggucgcca

SEQ ID NO: 3986 - RNA, 23 nt, Artificial Sequence
  source: /note="Description of Artificial Sequence: Synthetic oligonucleotide"
ucaucagcuuuuccagggucgcc

SEQ ID NO: 3987 - RNA, 23 nt, Artificial Sequence
  source: /note="Description of Artificial Sequence: Synthetic oligonucleotide"
uucaucagcuuuuccagggucgc

SEQ ID NO: 3988 - RNA, 23 nt, Artificial Sequence
  source: /note="Description of Artificial Sequence: Synthetic oligonucleotide"
uuucaucagcuuuuccagggucg

SEQ ID NO: 3989 - RNA, 23 nt, Artificial Sequence
  source: /note="Description of Artificial Sequence: Synthetic oligonucleotide"
ugccuucaucagcuuuuccaggg

SEQ ID NO: 3990 - RNA, 23 nt, Artificial Sequence
  source: /note="Description of Artificial Sequence: Synthetic oligonucleotide"
uggccuucaucagcuuuuccagg

SEQ ID NO: 3991 - RNA, 23 nt, Artificial Sequence
  source: /note="Description of Artificial Sequence: Synthetic oligonucleotide"
ucgaaggccuucaucagcuuuuc

SEQ ID NO: 3992 - RNA, 23 nt, Artificial Sequence
  source: /note="Description of Artificial Sequence: Synthetic oligonucleotide"
uucgaaggccuucaucagcuuuu

SEQ ID NO: 3993 - RNA, 23 nt, Artificial Sequence
  source: /note="Description of Artificial Sequence: Synthetic oligonucleotide"
ugacucgaaggccuucaucagcu

SEQ ID NO: 3994 - RNA, 23 nt, Artificial Sequence
  source: /note="Description of Artificial Sequence: Synthetic oligonucleotide"
uggacucgaaggccuucaucagc

SEQ ID NO: 3995 - RNA, 23 nt, Artificial Sequence
  source: /note="Description of Artificial Sequence: Synthetic oligonucleotide"
ugggacucgaaggccuucaucag

SEQ ID NO: 3996 - RNA, 23 nt, Artificial Sequence
  source: /note="Description of Artificial Sequence: Synthetic oligonucleotide"
uagggacucgaaggccuucauca

SEQ ID NO: 3997 - RNA, 23 nt, Artificial Sequence
  source: /note="Description of Artificial Sequence: Synthetic oligonucleotide"
ugagggacucgaaggccuucauc

SEQ ID NO: 3998 - RNA, 23 nt, Artificial Sequence
  source: /note="Description of Artificial Sequence: Synthetic oligonucleotide"
uuugagggacucgaaggccuuca

SEQ ID NO: 3999 - RNA, 23 nt, Artificial Sequence
  source: /note="Description of Artificial Sequence: Synthetic oligonucleotide"
uacuugagggacucgaaggccuu

SEQ ID NO: 4000 - RNA, 23 nt, Artificial Sequence
  source: /note="Description of Artificial Sequence: Synthetic oligonucleotide"
ugacuugagggacucgaaggccu

SEQ ID NO: 4001 - RNA, 23 nt, Artificial Sequence
  source: /note="Description of Artificial Sequence: Synthetic oligonucleotide"
uggacuugagggacucgaaggcc

SEQ ID NO: 4002 - RNA, 23 nt, Artificial Sequence
  source: /note="Description of Artificial Sequence: Synthetic oligonucleotide"
uaggacuugagggacucgaaggc

SEQ ID NO: 4003 - RNA, 23 nt, Artificial Sequence
  source: /note="Description of Artificial Sequence: Synthetic oligonucleotide"
uaaggacuugagggacucgaagg

SEQ ID NO: 4004 - RNA, 23 nt, Artificial Sequence
  source: /note="Description of Artificial Sequence: Synthetic oligonucleotide"
ugaaggacuugagggacucgaag

SEQ ID NO: 4005 - RNA, 23 nt, Artificial Sequence
  source: /note="Description of Artificial Sequence: Synthetic oligonucleotide"
uggaaggacuugagggacucgaa

SEQ ID NO: 4006 - RNA, 23 nt, Artificial Sequence
  source: /note="Description of Artificial Sequence: Synthetic oligonucleotide"
uuggaaggacuugagggacucga

SEQ ID NO: 4007 - RNA, 23 nt, Artificial Sequence
  source: /note="Description of Artificial Sequence: Synthetic oligonucleotide"
ugcuggaaggacuugagggacuc

SEQ ID NO: 4008 - RNA, 23 nt, Artificial Sequence
  source: /note="Description of Artificial Sequence: Synthetic oligonucleotide"
cgagucggcccgaggccuccggg

SEQ ID NO: 4009 - RNA, 21 nt, Artificial Sequence
  source: /note="Description of Artificial Sequence: Synthetic oligonucleotide"
agucggcccgaggccuccgga

SEQ ID NO: 4010 - RNA, 23 nt, Artificial Sequence
  source: /note="Description of Artificial Sequence: Synthetic oligonucleotide"
uccggaggccucgggccgacucg

SEQ ID NO: 4011 - RNA, 23 nt, Artificial Sequence
  source: /note="Description of Artificial Sequence: Synthetic oligonucleotide"
uggcaguccccggaggccucggg

SEQ ID NO: 4012 - RNA, 23 nt, Artificial Sequence
  source: /note="Description of Artificial Sequence: Synthetic oligonucleotide"
ucggucucccgcccggcacggca

SEQ ID NO: 4013 - RNA, 23 nt, Artificial Sequence
  source: /note="Description of Artificial Sequence: Synthetic oligonucleotide"
uagcuuuuccagggucgccaugg

SEQ ID NO: 4014 - RNA, 23 nt, Artificial Sequence
  source: /note="Description of Artificial Sequence: Synthetic oligonucleotide"
ucagcuuuuccagggucgccaug

SEQ ID NO: 4015 - RNA, 23 nt, Artificial Sequence
  source: /note="Description of Artificial Sequence: Synthetic oligonucleotide"
uggccuucaucagcuuuuccagg

SEQ ID NO: 4016 - RNA, 23 nt, Artificial Sequence
  source: /note="Description of Artificial Sequence: Synthetic oligonucleotide"
ugggacucgaaggccuucaucag

SEQ ID NO: 4017 - RNA, 23 nt, Artificial Sequence
  source: /note="Description of Artificial Sequence: Synthetic oligonucleotide"
uggacuugagggacucgaaggcc

SEQ ID NO: 4018 - RNA, 23 nt, Artificial Sequence
  source: /note="Description of Artificial Sequence: Synthetic oligonucleotide"
uaggacuugagggacucgaaggc

SEQ ID NO: 4019 - RNA, 21 nt, Artificial Sequence
  source: /note="Description of Artificial Sequence: Synthetic oligonucleotide"
acccuggaaaagcugaugaaa

SEQ ID NO: 4020 - RNA, 21 nt, Artificial Sequence
  source: /note="Description of Artificial Sequence: Synthetic oligonucleotide"
ccaucgcgacccuggaaaaga

SEQ ID NO: 4021 - RNA, 19 nt, Artificial Sequence
  source: /note="Description of Artificial Sequence: Synthetic oligonucleotide"
ccuggaaaagcugaugaaa

SEQ ID NO: 4022 - RNA, 19 nt, Artificial Sequence
  source: /note="Description of Artificial Sequence: Synthetic oligonucleotide"
ccuggaaaaguugaugaaa

SEQ ID NO: 4023 - RNA, 21 nt, Artificial Sequence
  source: /note="Description of Artificial Sequence: Synthetic oligonucleotide"
ccauggcgacccuggaaaaga

SEQ ID NO: 4024 - RNA, 19 nt, Artificial Sequence
  source: /note="Description of Artificial Sequence: Synthetic oligonucleotide"
auggcgacccuggaaaaga

SEQ ID NO: 4025 - RNA, 21 nt, Artificial Sequence
  source: /note="Description of Artificial Sequence: Synthetic oligonucleotide"
ccauggcgacccuggaaaaga

SEQ ID NO: 4026 - RNA, 21 nt, Artificial Sequence
  source: /note="Description of Artificial Sequence: Synthetic oligonucleotide"
ccgcucagguucugcuuuuaa

SEQ ID NO: 4027 - RNA, 19 nt, Artificial Sequence
  source: /note="Description of Artificial Sequence: Synthetic oligonucleotide"
cuucgagucccucaaguca

SEQ ID NO: 4028 - RNA, 21 nt, Artificial Sequence
  source: /note="Description of Artificial Sequence: Synthetic oligonucleotide"
acccuggaaaagcugaugaaa

SEQ ID NO: 4029 - RNA, 21 nt, Artificial Sequence
  source: /note="Description of Artificial Sequence: Synthetic oligonucleotide"
ccgcucagguucugauuuuaa

SEQ ID NO: 4030 - RNA, 21 nt, Artificial Sequence
  source: /note="Description of Artificial Sequence: Synthetic oligonucleotide"
ccggucagguucugcuuuuaa

SEQ ID NO: 4031 - RNA, 19 nt, Artificial Sequence
  source: /note="Description of Artificial Sequence: Synthetic oligonucleotide"
ccaggaaaagcugaugaaa

SEQ ID NO: 4032 - RNA, 19 nt, Artificial Sequence
  source: /note="Description of Artificial Sequence: Synthetic oligonucleotide"
ccuggaaaagcuuaugaaa

SEQ ID NO: 4033 - RNA, 21 nt, Artificial Sequence
  source: /note="Description of Artificial Sequence: Synthetic oligonucleotide"
ccgcacagguucugcuuuuaa

SEQ ID NO: 4034 - RNA, 19 nt, Artificial Sequence
  source: /note="Description of Artificial Sequence: Synthetic oligonucleotide"
cguggaaaagcugaugaaa

SEQ ID NO: 4035 - RNA, 21 nt, Artificial Sequence
  source: /note="Description of Artificial Sequence: Synthetic oligonucleotide"
ccccucagguucugcuuuuaa

SEQ ID NO: 4036 - RNA, 21 nt, Artificial Sequence
  source: /note="Description of Artificial Sequence: Synthetic oligonucleotide"
ucccucaaguccuuccagcaa

SEQ ID NO: 4037 - RNA, 21 nt, Artificial Sequence
  source: /note="Description of Artificial Sequence: Synthetic oligonucleotide"
gcgacccuggaaaagcugaua

SEQ ID NO: 4038 - RNA, 21 nt, Artificial Sequence
  source: /note="Description of Artificial Sequence: Synthetic oligonucleotide"
gcgucccuggaaaagcugaua

SEQ ID NO: 4039 - RNA, 21 nt, Artificial Sequence
  source: /note="Description of Artificial Sequence: Synthetic oligonucleotide"
gccuucgagucccuuaaguca

SEQ ID NO: 4040 - RNA, 21 nt, Artificial Sequence
  source: /note="Description of Artificial Sequence: Synthetic oligonucleotide"
ccauggugacccuggaaaaga

SEQ ID NO: 4041 - RNA, 19 nt, Artificial Sequence
  source: /note="Description of Artificial Sequence: Synthetic oligonucleotide"
gcuggaaaagcugaugaaa

SEQ ID NO: 4042 - RNA, 21 nt, Artificial Sequence
  source: /note="Description of Artificial Sequence: Synthetic oligonucleotide"
ucccacaaguccuuccagcaa

SEQ ID NO: 4043 - RNA, 21 nt, Artificial Sequence
  source: /note="Description of Artificial Sequence: Synthetic oligonucleotide"
ucgcucaaguccuuucagcaa

SEQ ID NO: 4044 - RNA, 21 nt, Artificial Sequence
  source: /note="Description of Artificial Sequence: Synthetic oligonucleotide"
ccauggcgauccuggaaaaga

SEQ ID NO: 4045 - RNA, 21 nt, Artificial Sequence
  source: /note="Description of Artificial Sequence: Synthetic oligonucleotide"
ccgcucagguucugcuuuuaa

SEQ ID NO: 4046 - RNA, 21 nt, Artificial Sequence
  source: /note="Description of Artificial Sequence: Synthetic oligonucleotide"
ucccucaaguccuuucagcaa

SEQ ID NO: 4047 - RNA, 21 nt, Artificial Sequence
  source: /note="Description of Artificial Sequence: Synthetic oligonucleotide"
ccuuggcgacccuggaaaaga

SEQ ID NO: 4048 - RNA, 19 nt, Artificial Sequence
  source: /note="Description of Artificial Sequence: Synthetic oligonucleotide"
ccucaaguccuuccagcaa

SEQ ID NO: 4049 - RNA, 21 nt, Artificial Sequence
  source: /note="Description of Artificial Sequence: Synthetic oligonucleotide"
gcguucgagucccucaaguca

SEQ ID NO: 4050 - RNA, 21 nt, Artificial Sequence
  source: /note="Description of Artificial Sequence: Synthetic oligonucleotide"
gcgacccuggaaaagcugaua

SEQ ID NO: 4051 - RNA, 19 nt, Artificial Sequence
  source: /note="Description of Artificial Sequence: Synthetic oligonucleotide"
gcucagguucugcuuuuaa

SEQ ID NO: 4052 - RNA, 21 nt, Artificial Sequence
  source: /note="Description of Artificial Sequence: Synthetic oligonucleotide"
ucccucaaguccuuccagcaa

SEQ ID NO: 4053 - RNA, 21 nt, Artificial Sequence
  source: /note="Description of Artificial Sequence: Synthetic oligonucleotide"
ccaaggcgacccuggaaaaga

SEQ ID NO: 4054 - RNA, 21 nt, Artificial Sequence
  source: /note="Description of Artificial Sequence: Synthetic oligonucleotide"
ccgcucagguucugcuuuuaa

SEQ ID NO: 4055 - RNA, 19 nt, Artificial Sequence
  source: /note="Description of Artificial Sequence: Synthetic oligonucleotide"
gacccuggaaaugcugaua

SEQ ID NO: 4056 - RNA, 21 nt, Artificial Sequence
  source: /note="Description of Artificial Sequence: Synthetic oligonucleotide"
gcgagccuggaaaagcugaua

SEQ ID NO: 4057 - RNA, 21 nt, Artificial Sequence
  source: /note="Description of Artificial Sequence: Synthetic oligonucleotide"
ccgcucagguucugcuuuuaa

SEQ ID NO: 4058 - RNA, 21 nt, Artificial Sequence
  source: /note="Description of Artificial Sequence: Synthetic oligonucleotide"
gccaucgagucccucaaguca

SEQ ID NO: 4059 - RNA, 21 nt, Artificial Sequence
  source: /note="Description of Artificial Sequence: Synthetic oligonucleotide"
gccacccuggaaaagcugaua

SEQ ID NO: 4060 - RNA, 21 nt, Artificial Sequence
  source: /note="Description of Artificial Sequence: Synthetic oligonucleotide"
uccgucaaguccuuccagcaa

SEQ ID NO: 4061 - RNA, 19 nt, Artificial Sequence
  source: /note="Description of Artificial Sequence: Synthetic oligonucleotide"
gacccuggaaaagcugaua

SEQ ID NO: 4062 - RNA, 21 nt, Artificial Sequence
  source: /note="Description of Artificial Sequence: Synthetic oligonucleotide"
gccuacgagucccucaaguca

SEQ ID NO: 4063 - RNA, 21 nt, Artificial Sequence
  source: /note="Description of Artificial Sequence: Synthetic oligonucleotide"
cagcuuccucagccgccgcca

SEQ ID NO: 4064 - RNA, 21 nt, Artificial Sequence
  source: /note="Description of Artificial Sequence: Synthetic oligonucleotide"
ucagcuuccucagccgccgca

SEQ ID NO: 4065 - RNA, 21 nt, Artificial Sequence
  source: /note="Description of Artificial Sequence: Synthetic oligonucleotide"
agcuuccucagccgccgccga

SEQ ID NO: 4066 - RNA, 21 nt, Artificial Sequence
  source: /note="Description of Artificial Sequence: Synthetic oligonucleotide"
ucgcucaaguccuuccagcaa

SEQ ID NO: 4067 - RNA, 21 nt, Artificial Sequence
  source: /note="Description of Artificial Sequence: Synthetic oligonucleotide"
gcuuccucagccgccgccgca

SEQ ID NO: 4068 - RNA, 21 nt, Artificial Sequence
  source: /note="Description of Artificial Sequence: Synthetic oligonucleotide"
gcgacccuggaaaugcugaua

SEQ ID NO: 4069 - RNA, 21 nt, Artificial Sequence
  source: /note="Description of Artificial Sequence: Synthetic oligonucleotide"
gccuucgagucccucaaguca

SEQ ID NO: 4070 - RNA, 23 nt, Artificial Sequence
  source: /note="Description of Artificial Sequence: Synthetic oligonucleotide"
uuucaucagcuuuuccaggguuc

SEQ ID NO: 4071 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgcgauggcg

SEQ ID NO: 4072 - RNA, 21 nt, Artificial Sequence
  source: /note="Description of Artificial Sequence: Synthetic oligonucleotide"
uuucaucagcuuuuccagggu

SEQ ID NO: 4073 - RNA, 21 nt, Artificial Sequence
  source: /note="Description of Artificial Sequence: Synthetic oligonucleotide"
uuucaucaacuuuuccagggu

SEQ ID NO: 4074 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccauggcg

SEQ ID NO: 4075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccaugg

SEQ ID NO: 4076 - RNA, 23 nt, Artificial Sequence
  source: /note="Description of Artificial Sequence: Synthetic oligonucleotide"
uuucaucagcuuuuccagggucg

SEQ ID NO: 4077 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccauuc

SEQ ID NO: 4078 - RNA, 23 nt, Artificial Sequence
  source: /note="Description of Artificial Sequence: Synthetic oligonucleotide"
uuaaaagcagaaccugagcggcc

SEQ ID NO: 4079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaaggc

SEQ ID NO: 4080 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaaatcagaaccugagcggcc

SEQ ID NO: 4081 - RNA, 23 nt, Artificial Sequence
  source: /note="Description of Artificial Sequence: Synthetic oligonucleotide"
uuaaaagcagaaccugaccggcc

SEQ ID NO: 4082 - RNA, 21 nt, Artificial Sequence
  source: /note="Description of Artificial Sequence: Synthetic oligonucleotide"
uuucaucagcuuuuccugggu

SEQ ID NO: 4083 - RNA, 21 nt, Artificial Sequence
  source: /note="Description of Artificial Sequence: Synthetic oligonucleotide"
uuucauaagcuuuuccagggu

SEQ ID NO: 4084 - RNA, 21 nt, Artificial Sequence
  source: /note="Description of Artificial Sequence: Synthetic oligonucleotide"
uuucaucagcuuuuccagguc

SEQ ID NO: 4085 - RNA, 23 nt, Artificial Sequence
  source: /note="Description of Artificial Sequence: Synthetic oligonucleotide"
uuaaaagcagaaccugugcggcc

SEQ ID NO: 4086 - RNA, 21 nt, Artificial Sequence
  source: /note="Description of Artificial Sequence: Synthetic oligonucleotide"
uuucaucagcuuuuccacggu

SEQ ID NO: 4087 - RNA, 23 nt, Artificial Sequence
  source: /note="Description of Artificial Sequence: Synthetic oligonucleotide"
uuaaaagcagaaccugaggggcc

SEQ ID NO: 4088 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugagggauc

SEQ ID NO: 4089 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaaggccu

SEQ ID NO: 4090 - RNA, 23 nt, Artificial Sequence
  source: /note="Description of Artificial Sequence: Synthetic oligonucleotide"
uaucagcuuuuccagggucgccg

SEQ ID NO: 4091 - RNA, 23 nt, Artificial Sequence
  source: /note="Description of Artificial Sequence: Synthetic oligonucleotide"
uaucagcuuuuccagggacgccg

SEQ ID NO: 4092 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactuaagggacucgaaggccu

SEQ ID NO: 4093 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucaccaugguc

SEQ ID NO: 4094 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaaggcuc

SEQ ID NO: 4095 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugagggacu

SEQ ID NO: 4096 - RNA, 21 nt, Artificial Sequence
  source: /note="Description of Artificial Sequence: Synthetic oligonucleotide"
uuucaucagcuuuuccagcgu

SEQ ID NO: 4097 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugugggacu

SEQ ID NO: 4098 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaagcu

SEQ ID NO: 4099 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctgaaaggacuugagcgacu

SEQ ID NO: 4100 - RNA, 23 nt, Artificial Sequence
  source: /note="Description of Artificial Sequence: Synthetic oligonucleotide"
uaucagcuuuuccagggacgcuc

SEQ ID NO: 4101 - RNA, 23 nt, Artificial Sequence
  source: /note="Description of Artificial Sequence: Synthetic oligonucleotide"
uaucagcuuuuccagggucgccg

SEQ ID NO: 4102 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccauggcg

SEQ ID NO: 4103 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccaggaucgccaugguc

SEQ ID NO: 4104 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctgaaaggacuugagggacu

SEQ ID NO: 4105 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccaaggcg

SEQ ID NO: 4106 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccaugguc

SEQ ID NO: 4107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugaggcg

SEQ ID NO: 4108 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaacgccu

SEQ ID NO: 4109 - RNA, 23 nt, Artificial Sequence
  source: /note="Description of Artificial Sequence: Synthetic oligonucleotide"
uaucagcuuuuccagggucgccg

SEQ ID NO: 4110 - RNA, 21 nt, Artificial Sequence
  source: /note="Description of Artificial Sequence: Synthetic oligonucleotide"
uuaaaagcagaaccugagcug

SEQ ID NO: 4111 - RNA, 23 nt, Artificial Sequence
  source: /note="Description of Artificial Sequence: Synthetic oligonucleotide"
uaucagcuuuuccagggucgccg

SEQ ID NO: 4112 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccuuggcg

SEQ ID NO: 4113 - RNA, 23 nt, Artificial Sequence
  source: /note="Description of Artificial Sequence: Synthetic oligonucleotide"
uuaaaagcagaaccugagcggcc

SEQ ID NO: 4114 - RNA, 21 nt, Artificial Sequence
  source: /note="Description of Artificial Sequence: Synthetic oligonucleotide"
uaucagcauuuccagggucuc

SEQ ID NO: 4115 - RNA, 23 nt, Artificial Sequence
  source: /note="Description of Artificial Sequence: Synthetic oligonucleotide"
uaucagcuuuuccaggcucgccg

SEQ ID NO: 4116 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaaaagcagaaccugagcggcc

SEQ ID NO: 4117 - RNA, 23 nt, Artificial Sequence
  source: /note="Description of Artificial Sequence: Synthetic oligonucleotide"
uaucagcuuuuccagggucgcug

SEQ ID NO: 4118 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgauggccu

SEQ ID NO: 4119 - RNA, 23 nt, Artificial Sequence
  source: /note="Description of Artificial Sequence: Synthetic oligonucleotide"
uaucagcuuuuccaggguggcuc

SEQ ID NO: 4120 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugacggacu

SEQ ID NO: 4121 - RNA, 23 nt, Artificial Sequence
  source: /note="Description of Artificial Sequence: Synthetic oligonucleotide"
uaucagcuuuuccagggucgccg

SEQ ID NO: 4122 - RNA, 21 nt, Artificial Sequence
  source: /note="Description of Artificial Sequence: Synthetic oligonucleotide"
uaucagcuuuuccagggucug

SEQ ID NO: 4123 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucguaggccu

SEQ ID NO: 4124 - RNA, 21 nt, Artificial Sequence
  source: /note="Description of Artificial Sequence: Synthetic oligonucleotide"
uaucagcuuuuccagggucgc

SEQ ID NO: 4125 - RNA, 21 nt, Artificial Sequence
  source: /note="Description of Artificial Sequence: Synthetic oligonucleotide"
uuaaaagcagaaccugagcug

SEQ ID NO: 4126 - RNA, 23 nt, Artificial Sequence
  source: /note="Description of Artificial Sequence: Synthetic oligonucleotide"
uggcggcggcugaggaagcugag

SEQ ID NO: 4127 - RNA, 23 nt, Artificial Sequence
  source: /note="Description of Artificial Sequence: Synthetic oligonucleotide"
ugcggcggcugaggaagcugagg

SEQ ID NO: 4128 - RNA, 23 nt, Artificial Sequence
  source: /note="Description of Artificial Sequence: Synthetic oligonucleotide"
uaucagcuuuuccaggcucgcuc

SEQ ID NO: 4129 - RNA, 23 nt, Artificial Sequence
  source: /note="Description of Artificial Sequence: Synthetic oligonucleotide"
ucggcggcggcugaggaagcuga

SEQ ID NO: 4130 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugagcgacu

SEQ ID NO: 4131 - RNA, 23 nt, Artificial Sequence
  source: /note="Description of Artificial Sequence: Synthetic oligonucleotide"
ugcggcggcggcugaggaagcug

SEQ ID NO: 4132 - RNA, 23 nt, Artificial Sequence
  source: /note="Description of Artificial Sequence: Synthetic oligonucleotide"
uaucagcuuuuccaggguggccg

SEQ ID NO: 4133 - RNA, 21 nt, Artificial Sequence
  source: /note="Description of Artificial Sequence: Synthetic oligonucleotide"
uaucagcauuuccaggguccu

SEQ ID NO: 4134 - RNA, 21 nt, Artificial Sequence
  source: /note="Description of Artificial Sequence: Synthetic oligonucleotide"
acccuggaaaagcugaugaag

SEQ ID NO: 4135 - RNA, 21 nt, Artificial Sequence
  source: /note="Description of Artificial Sequence: Synthetic oligonucleotide"
ccauggcgacccuggaaaagc

SEQ ID NO: 4136 - RNA, 21 nt, Artificial Sequence
  source: /note="Description of Artificial Sequence: Synthetic oligonucleotide"
gccuucgagucccucaagucc

SEQ ID NO: 4137 - RNA, 21 nt, Artificial Sequence
  source: /note="Description of Artificial Sequence: Synthetic oligonucleotide"
ucccucaaguccuuccagcag

SEQ ID NO: 4138 - RNA, 21 nt, Artificial Sequence
  source: /note="Description of Artificial Sequence: Synthetic oligonucleotide"
ccgcucagguucugcuuuuac

SEQ ID NO: 4139 - RNA, 21 nt, Artificial Sequence
  source: /note="Description of Artificial Sequence: Synthetic oligonucleotide"
gcgacccuggaaaagcugaug

SEQ ID NO: 4140 - RNA, 23 nt, Artificial Sequence
  source: /note="Description of Artificial Sequence: Synthetic oligonucleotide"
cucagcuuccucagccgccgccg

SEQ ID NO: 4141 - RNA, 23 nt, Artificial Sequence
  source: /note="Description of Artificial Sequence: Synthetic oligonucleotide"
ccucagcuuccucagccgccgcc

SEQ ID NO: 4142 - RNA, 23 nt, Artificial Sequence
  source: /note="Description of Artificial Sequence: Synthetic oligonucleotide"
ucagcuuccucagccgccgccgc

SEQ ID NO: 4143 - RNA, 23 nt, Artificial Sequence
  source: /note="Description of Artificial Sequence: Synthetic oligonucleotide"
cagcuuccucagccgccgccgca

SEQ ID NO: 4144 - RNA, 21 nt, Artificial Sequence
  source: /note="Description of Artificial Sequence: Synthetic oligonucleotide"
ccaucgcgacccuggaaaaga

SEQ ID NO: 4145 - RNA, 19 nt, Artificial Sequence
  source: /note="Description of Artificial Sequence: Synthetic oligonucleotide"
ccuggaaaagcugaugaaa

SEQ ID NO: 4146 - RNA, 19 nt, Artificial Sequence
  source: /note="Description of Artificial Sequence: Synthetic oligonucleotide"
ccuggaaaaguugaugaaa

SEQ ID NO: 4147 - RNA, 19 nt, Artificial Sequence
  source: /note="Description of Artificial Sequence: Synthetic oligonucleotide"
auggcgacccuggaaaaga

SEQ ID NO: 4148 - RNA, 19 nt, Artificial Sequence
  source: /note="Description of Artificial Sequence: Synthetic oligonucleotide"
cuucgagucccucaaguca

SEQ ID NO: 4149 - RNA, 21 nt, Artificial Sequence
  source: /note="Description of Artificial Sequence: Synthetic oligonucleotide"
ccgcucagguucugauuuuaa

SEQ ID NO: 4150 - RNA, 21 nt, Artificial Sequence
  source: /note="Description of Artificial Sequence: Synthetic oligonucleotide"
ccggucagguucugcuuuuaa

SEQ ID NO: 4151 - RNA, 19 nt, Artificial Sequence
  source: /note="Description of Artificial Sequence: Synthetic oligonucleotide"
ccaggaaaagcugaugaaa

SEQ ID NO: 4152 - RNA, 19 nt, Artificial Sequence
  source: /note="Description of Artificial Sequence: Synthetic oligonucleotide"
ccuggaaaagcuuaugaaa

SEQ ID NO: 4153 - RNA, 21 nt, Artificial Sequence
  source: /note="Description of Artificial Sequence: Synthetic oligonucleotide"
ccgcacagguucugcuuuuaa

SEQ ID NO: 4154 - RNA, 19 nt, Artificial Sequence
  source: /note="Description of Artificial Sequence: Synthetic oligonucleotide"
cguggaaaagcugaugaaa

SEQ ID NO: 4155 - RNA, 21 nt, Artificial Sequence
  source: /note="Description of Artificial Sequence: Synthetic oligonucleotide"
ccccucagguucugcuuuuaa

SEQ ID NO: 4156 - RNA, 21 nt, Artificial Sequence
  source: /note="Description of Artificial Sequence: Synthetic oligonucleotide"
gcgucccuggaaaagcugaua

SEQ ID NO: 4157 - RNA, 21 nt, Artificial Sequence
  source: /note="Description of Artificial Sequence: Synthetic oligonucleotide"
gccuucgagucccuuaaguca

SEQ ID NO: 4158 - RNA, 21 nt, Artificial Sequence
  source: /note="Description of Artificial Sequence: Synthetic oligonucleotide"
ccauggugacccuggaaaaga

SEQ ID NO: 4159 - RNA, 19 nt, Artificial Sequence
  source: /note="Description of Artificial Sequence: Synthetic oligonucleotide"
gcuggaaaagcugaugaaa

SEQ ID NO: 4160 - RNA, 21 nt, Artificial Sequence
  source: /note="Description of Artificial Sequence: Synthetic oligonucleotide"
ucccacaaguccuuccagcaa

SEQ ID NO: 4161 - RNA, 21 nt, Artificial Sequence
  source: /note="Description of Artificial Sequence: Synthetic oligonucleotide"
ucgcucaaguccuuucagcaa

SEQ ID NO: 4162 - RNA, 21 nt, Artificial Sequence
  source: /note="Description of Artificial Sequence: Synthetic oligonucleotide"
ccauggcgauccuggaaaaga

SEQ ID NO: 4163 - RNA, 21 nt, Artificial Sequence
  source: /note="Description of Artificial Sequence: Synthetic oligonucleotide"
ucccucaaguccuuucagcaa

SEQ ID NO: 4164 - RNA, 21 nt, Artificial Sequence
  source: /note="Description of Artificial Sequence: Synthetic oligonucleotide"
ccuuggcgacccuggaaaaga

SEQ ID NO: 4165 - RNA, 19 nt, Artificial Sequence
  source: /note="Description of Artificial Sequence: Synthetic oligonucleotide"
ccucaaguccuuccagcaa

SEQ ID NO: 4166 - RNA, 21 nt, Artificial Sequence
  source: /note="Description of Artificial Sequence: Synthetic oligonucleotide"
gcguucgagucccucaaguca

SEQ ID NO: 4167 - RNA, 19 nt, Artificial Sequence
  source: /note="Description of Artificial Sequence: Synthetic oligonucleotide"
gcucagguucugcuuuuaa

SEQ ID NO: 4168 - RNA, 21 nt, Artificial Sequence
  source: /note="Description of Artificial Sequence: Synthetic oligonucleotide"
ccaaggcgacccuggaaaaga

SEQ ID NO: 4169 - RNA, 19 nt, Artificial Sequence
  source: /note="Description of Artificial Sequence: Synthetic oligonucleotide"
gacccuggaaaugcugaua

SEQ ID NO: 4170 - RNA, 21 nt, Artificial Sequence
  source: /note="Description of Artificial Sequence: Synthetic oligonucleotide"
gcgagccuggaaaagcugaua

SEQ ID NO: 4171 - RNA, 21 nt, Artificial Sequence
  source: /note="Description of Artificial Sequence: Synthetic oligonucleotide"
gccaucgagucccucaaguca

SEQ ID NO: 4172 - RNA, 21 nt, Artificial Sequence
  source: /note="Description of Artificial Sequence: Synthetic oligonucleotide"
gccacccuggaaaagcugaua

SEQ ID NO: 4173 - RNA, 21 nt, Artificial Sequence
  source: /note="Description of Artificial Sequence: Synthetic oligonucleotide"
uccgucaaguccuuccagcaa

SEQ ID NO: 4174 - RNA, 19 nt, Artificial Sequence
  source: /note="Description of Artificial Sequence: Synthetic oligonucleotide"
gacccuggaaaagcugaua

SEQ ID NO: 4175 - RNA, 21 nt, Artificial Sequence
  source: /note="Description of Artificial Sequence: Synthetic oligonucleotide"
gccuacgagucccucaaguca

SEQ ID NO: 4176 - RNA, 21 nt, Artificial Sequence
  source: /note="Description of Artificial Sequence: Synthetic oligonucleotide"
cagcuuccucagccgccgcca

SEQ ID NO: 4177 - RNA, 21 nt, Artificial Sequence
  source: /note="Description of Artificial Sequence: Synthetic oligonucleotide"
ucagcuuccucagccgccgca

SEQ ID NO: 4178 - RNA, 21 nt, Artificial Sequence
  source: /note="Description of Artificial Sequence: Synthetic oligonucleotide"
agcuuccucagccgccgccga

SEQ ID NO: 4179 - RNA, 21 nt, Artificial Sequence
  source: /note="Description of Artificial Sequence: Synthetic oligonucleotide"
ucgcucaaguccuuccagcaa

SEQ ID NO: 4180 - RNA, 21 nt, Artificial Sequence
  source: /note="Description of Artificial Sequence: Synthetic oligonucleotide"
gcuuccucagccgccgccgca

SEQ ID NO: 4181 - RNA, 21 nt, Artificial Sequence
  source: /note="Description of Artificial Sequence: Synthetic oligonucleotide"
gcgacccuggaaaugcugaua

SEQ ID NO: 4182 - RNA, 23 nt, Artificial Sequence
  source: /note="Description of Artificial Sequence: Synthetic oligonucleotide"
uuucaucagcuuuuccaggguuc

SEQ ID NO: 4183 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgcgauggcg

SEQ ID NO: 4184 - RNA, 21 nt, Artificial Sequence
  source: /note="Description of Artificial Sequence: Synthetic oligonucleotide"
uuucaucagcuuuuccagggu

SEQ ID NO: 4185 - RNA, 21 nt, Artificial Sequence
  source: /note="Description of Artificial Sequence: Synthetic oligonucleotide"
uuucaucaacuuuuccagggu

SEQ ID NO: 4186 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccauggcg

SEQ ID NO: 4187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccaugg

SEQ ID NO: 4188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccauuc

SEQ ID NO: 4189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaaggc

SEQ ID NO: 4190 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuaaaatcagaaccugagcggcc

SEQ ID NO: 4191 - RNA, 23 nt, Artificial Sequence
  source: /note="Description of Artificial Sequence: Synthetic oligonucleotide"
uuaaaagcagaaccugaccggcc

SEQ ID NO: 4192 - RNA, 21 nt, Artificial Sequence
  source: /note="Description of Artificial Sequence: Synthetic oligonucleotide"
uuucaucagcuuuuccugggu

SEQ ID NO: 4193 - RNA, 21 nt, Artificial Sequence
  source: /note="Description of Artificial Sequence: Synthetic oligonucleotide"
uuucauaagcuuuuccagggu

SEQ ID NO: 4194 - RNA, 21 nt, Artificial Sequence
  source: /note="Description of Artificial Sequence: Synthetic oligonucleotide"
uuucaucagcuuuuccagguc

SEQ ID NO: 4195 - RNA, 23 nt, Artificial Sequence
  source: /note="Description of Artificial Sequence: Synthetic oligonucleotide"
uuaaaagcagaaccugugcggcc

SEQ ID NO: 4196 - RNA, 21 nt, Artificial Sequence
  source: /note="Description of Artificial Sequence: Synthetic oligonucleotide"
uuucaucagcuuuuccacggu

SEQ ID NO: 4197 - RNA, 23 nt, Artificial Sequence
  source: /note="Description of Artificial Sequence: Synthetic oligonucleotide"
uuaaaagcagaaccugaggggcc

SEQ ID NO: 4198 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugagggauc

SEQ ID NO: 4199 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaaggccu

SEQ ID NO: 4200 - RNA, 23 nt, Artificial Sequence
  source: /note="Description of Artificial Sequence: Synthetic oligonucleotide"
uaucagcuuuuccagggucgccg

SEQ ID NO: 4201 - RNA, 23 nt, Artificial Sequence
  source: /note="Description of Artificial Sequence: Synthetic oligonucleotide"
uaucagcuuuuccagggacgccg

SEQ ID NO: 4202 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactuaagggacucgaaggccu

SEQ ID NO: 4203 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucaccaugguc

SEQ ID NO: 4204 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaaggcuc

SEQ ID NO: 4205 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugagggacu

SEQ ID NO: 4206 - RNA, 21 nt, Artificial Sequence
  source: /note="Description of Artificial Sequence: Synthetic oligonucleotide"
uuucaucagcuuuuccagcgu

SEQ ID NO: 4207 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugugggacu

SEQ ID NO: 4208 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaagcu

SEQ ID NO: 4209 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctgaaaggacuugagcgacu

SEQ ID NO: 4210 - RNA, 23 nt, Artificial Sequence
  source: /note="Description of Artificial Sequence: Synthetic oligonucleotide"
uaucagcuuuuccagggacgcuc

SEQ ID NO: 4211 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccaggaucgccaugguc

SEQ ID NO: 4212 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctgaaaggacuugagggacu

SEQ ID NO: 4213 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccaaggcg

SEQ ID NO: 4214 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccaugguc

SEQ ID NO: 4215 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugaggcg

SEQ ID NO: 4216 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgaacgccu

SEQ ID NO: 4217 - RNA, 21 nt, Artificial Sequence
  source: /note="Description of Artificial Sequence: Synthetic oligonucleotide"
uuaaaagcagaaccugagcug

SEQ ID NO: 4218 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuutuccagggucgccuuggcg

SEQ ID NO: 4219 - RNA, 21 nt, Artificial Sequence
  source: /note="Description of Artificial Sequence: Synthetic oligonucleotide"
uaucagcauuuccagggucuc

SEQ ID NO: 4220 - RNA, 23 nt, Artificial Sequence
  source: /note="Description of Artificial Sequence: Synthetic oligonucleotide"
uaucagcuuuuccaggcucgccg

SEQ ID NO: 4221 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
utaaaagcagaaccugagcggcc

SEQ ID NO: 4222 - RNA, 23 nt, Artificial Sequence
  source: /note="Description of Artificial Sequence: Synthetic oligonucleotide"
uaucagcuuuuccagggucgcug

SEQ ID NO: 4223 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucgauggccu

SEQ ID NO: 4224 - RNA, 23 nt, Artificial Sequence
  source: /note="Description of Artificial Sequence: Synthetic oligonucleotide"
uaucagcuuuuccaggguggcuc

SEQ ID NO: 4225 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugacggacu

SEQ ID NO: 4226 - RNA, 21 nt, Artificial Sequence
  source: /note="Description of Artificial Sequence: Synthetic oligonucleotide"
uaucagcuuuuccagggucug

SEQ ID NO: 4227 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactugagggacucguaggccu

SEQ ID NO: 4228 - RNA, 21 nt, Artificial Sequence
  source: /note="Description of Artificial Sequence: Synthetic oligonucleotide"
uaucagcuuuuccagggucgc

SEQ ID NO: 4229 - RNA, 23 nt, Artificial Sequence
  source: /note="Description of Artificial Sequence: Synthetic oligonucleotide"
uggcggcggcugaggaagcugag

SEQ ID NO: 4230 - RNA, 23 nt, Artificial Sequence
  source: /note="Description of Artificial Sequence: Synthetic oligonucleotide"
ugcggcggcugaggaagcugagg

SEQ ID NO: 4231 - RNA, 23 nt, Artificial Sequence
  source: /note="Description of Artificial Sequence: Synthetic oligonucleotide"
uaucagcuuuuccaggcucgcuc

SEQ ID NO: 4232 - RNA, 23 nt, Artificial Sequence
  source: /note="Description of Artificial Sequence: Synthetic oligonucleotide"
ucggcggcggcugaggaagcuga

SEQ ID NO: 4233 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugctggaaggacuugagcgacu

SEQ ID NO: 4234 - RNA, 23 nt, Artificial Sequence
  source: /note="Description of Artificial Sequence: Synthetic oligonucleotide"
ugcggcggcggcugaggaagcug

SEQ ID NO: 4235 - RNA, 23 nt, Artificial Sequence
  source: /note="Description of Artificial Sequence: Synthetic oligonucleotide"
uaucagcuuuuccaggguggccg

SEQ ID NO: 4236 - RNA, 21 nt, Artificial Sequence
  source: /note="Description of Artificial Sequence: Synthetic oligonucleotide"
uaucagcauuuccaggguccu

SEQ ID NO: 4237 - RNA, 21 nt, Artificial Sequence
  source: /note="Description of Artificial Sequence: Synthetic oligonucleotide"
acagccgcugcugccucagca

SEQ ID NO: 4238 - RNA, 21 nt, Artificial Sequence
  source: /note="Description of Artificial Sequence: Synthetic oligonucleotide"
ccgccgcaggcacagccgcua

SEQ ID NO: 4239 - RNA, 21 nt, Artificial Sequence
  source: /note="Description of Artificial Sequence: Synthetic oligonucleotide"
ugaggagccgcugcaccgaca

SEQ ID NO: 4240 - RNA, 21 nt, Artificial Sequence
  source: /note="Description of Artificial Sequence: Synthetic oligonucleotide"
cugaggagccgcugcaccgaa

SEQ ID NO: 4241 - RNA, 21 nt, Artificial Sequence
  source: /note="Description of Artificial Sequence: Synthetic oligonucleotide"
guggcugaggagccgcugcaa

SEQ ID NO: 4242 - RNA, 21 nt, Artificial Sequence
  source: /note="Description of Artificial Sequence: Synthetic oligonucleotide"
ggcacagccgcugcugccuca

SEQ ID NO: 4243 - RNA, 21 nt, Artificial Sequence
  source: /note="Description of Artificial Sequence: Synthetic oligonucleotide"
cacagccgcugcugccucaga

SEQ ID NO: 4244 - RNA, 21 nt, Artificial Sequence
  source: /note="Description of Artificial Sequence: Synthetic oligonucleotide"
ggcugaggagccgcugcacca

SEQ ID NO: 4245 - RNA, 21 nt, Artificial Sequence
  source: /note="Description of Artificial Sequence: Synthetic oligonucleotide"
cuuccucagccgccgccgcaa

SEQ ID NO: 4246 - RNA, 21 nt, Artificial Sequence
  source: /note="Description of Artificial Sequence: Synthetic oligonucleotide"
aggcacagccgcugcugccua

SEQ ID NO: 4247 - RNA, 21 nt, Artificial Sequence
  source: /note="Description of Artificial Sequence: Synthetic oligonucleotide"
ccgcaggcacagccgcugcua

SEQ ID NO: 4248 - RNA, 21 nt, Artificial Sequence
  source: /note="Description of Artificial Sequence: Synthetic oligonucleotide"
gcuguggcugaggagccgcua

SEQ ID NO: 4249 - RNA, 21 nt, Artificial Sequence
  source: /note="Description of Artificial Sequence: Synthetic oligonucleotide"
gcacagccgcugcugccucaa

SEQ ID NO: 4250 - RNA, 21 nt, Artificial Sequence
  source: /note="Description of Artificial Sequence: Synthetic oligonucleotide"
gcaggcacagccgcugcugca

SEQ ID NO: 4251 - RNA, 21 nt, Artificial Sequence
  source: /note="Description of Artificial Sequence: Synthetic oligonucleotide"
gcugaggagccgcugcaccga

SEQ ID NO: 4252 - RNA, 21 nt, Artificial Sequence
  source: /note="Description of Artificial Sequence: Synthetic oligonucleotide"
ccgcugcugccucagccgcaa

SEQ ID NO: 4253 - RNA, 21 nt, Artificial Sequence
  source: /note="Description of Artificial Sequence: Synthetic oligonucleotide"
gccgcaggcacagccgcugca

SEQ ID NO: 4254 - RNA, 21 nt, Artificial Sequence
  source: /note="Description of Artificial Sequence: Synthetic oligonucleotide"
ccggcuguggcugaggagcca

SEQ ID NO: 4255 - RNA, 21 nt, Artificial Sequence
  source: /note="Description of Artificial Sequence: Synthetic oligonucleotide"
caggcacagccgcugcugcca

SEQ ID NO: 4256 - RNA, 21 nt, Artificial Sequence
  source: /note="Description of Artificial Sequence: Synthetic oligonucleotide"
cgccgcaggcacagccgcuga

SEQ ID NO: 4257 - RNA, 21 nt, Artificial Sequence
  source: /note="Description of Artificial Sequence: Synthetic oligonucleotide"
cuguggcugaggagccgcuga

SEQ ID NO: 4258 - RNA, 21 nt, Artificial Sequence
  source: /note="Description of Artificial Sequence: Synthetic oligonucleotide"
cagccgcugcugccucagcca

SEQ ID NO: 4259 - RNA, 21 nt, Artificial Sequence
  source: /note="Description of Artificial Sequence: Synthetic oligonucleotide"
gccgccgccgcaggcacagca

SEQ ID NO: 4260 - RNA, 21 nt, Artificial Sequence
  source: /note="Description of Artificial Sequence: Synthetic oligonucleotide"
ggcuguggcugaggagccgca

SEQ ID NO: 4261 - RNA, 21 nt, Artificial Sequence
  source: /note="Description of Artificial Sequence: Synthetic oligonucleotide"
uggcugaggagccgcugcaca

SEQ ID NO: 4262 - RNA, 21 nt, Artificial Sequence
  source: /note="Description of Artificial Sequence: Synthetic oligonucleotide"
cggcuguggcugaggagccga

SEQ ID NO: 4263 - RNA, 21 nt, Artificial Sequence
  source: /note="Description of Artificial Sequence: Synthetic oligonucleotide"
ggcccggcuguggcugaggaa

SEQ ID NO: 4264 - RNA, 21 nt, Artificial Sequence
  source: /note="Description of Artificial Sequence: Synthetic oligonucleotide"
ucagccgccgccgcaggcaca

SEQ ID NO: 4265 - RNA, 21 nt, Artificial Sequence
  source: /note="Description of Artificial Sequence: Synthetic oligonucleotide"
cgcaggcacagccgcugcuga

SEQ ID NO: 4266 - RNA, 21 nt, Artificial Sequence
  source: /note="Description of Artificial Sequence: Synthetic oligonucleotide"
gccgcugcugccucagccgca

SEQ ID NO: 4267 - RNA, 21 nt, Artificial Sequence
  source: /note="Description of Artificial Sequence: Synthetic oligonucleotide"
ccggcccggcuguggcugaga

SEQ ID NO: 4268 - RNA, 21 nt, Artificial Sequence
  source: /note="Description of Artificial Sequence: Synthetic oligonucleotide"
cggcccggcuguggcugagga

SEQ ID NO: 4269 - RNA, 21 nt, Artificial Sequence
  source: /note="Description of Artificial Sequence: Synthetic oligonucleotide"
uguggcugaggagccgcugca

SEQ ID NO: 4270 - RNA, 21 nt, Artificial Sequence
  source: /note="Description of Artificial Sequence: Synthetic oligonucleotide"
agccgccgccgcaggcacaga

SEQ ID NO: 4271 - RNA, 21 nt, Artificial Sequence
  source: /note="Description of Artificial Sequence: Synthetic oligonucleotide"
gcccggcuguggcugaggaga

SEQ ID NO: 4272 - RNA, 21 nt, Artificial Sequence
  source: /note="Description of Artificial Sequence: Synthetic oligonucleotide"
agccgcugcugccucagccga

SEQ ID NO: 4273 - RNA, 21 nt, Artificial Sequence
  source: /note="Description of Artificial Sequence: Synthetic oligonucleotide"
ccgccgccgcaggcacagcca

SEQ ID NO: 4274 - RNA, 21 nt, Artificial Sequence
  source: /note="Description of Artificial Sequence: Synthetic oligonucleotide"
uuccucagccgccgccgcaga

SEQ ID NO: 4275 - RNA, 21 nt, Artificial Sequence
  source: /note="Description of Artificial Sequence: Synthetic oligonucleotide"
cagccgccgccgcaggcacaa

SEQ ID NO: 4276 - RNA, 21 nt, Artificial Sequence
  source: /note="Description of Artificial Sequence: Synthetic oligonucleotide"
cucagccgccgccgcaggcaa

SEQ ID NO: 4277 - RNA, 21 nt, Artificial Sequence
  source: /note="Description of Artificial Sequence: Synthetic oligonucleotide"
gccgccgcaggcacagccgca

SEQ ID NO: 4278 - RNA, 21 nt, Artificial Sequence
  source: /note="Description of Artificial Sequence: Synthetic oligonucleotide"
cccggcuguggcugaggagca

SEQ ID NO: 4279 - RNA, 21 nt, Artificial Sequence
  source: /note="Description of Artificial Sequence: Synthetic oligonucleotide"
cgccgccgcaggcacagccga

SEQ ID NO: 4280 - RNA, 21 nt, Artificial Sequence
  source: /note="Description of Artificial Sequence: Synthetic oligonucleotide"
uccucagccgccgccgcagga

SEQ ID NO: 4281 - RNA, 21 nt, Artificial Sequence
  source: /note="Description of Artificial Sequence: Synthetic oligonucleotide"
ccucagccgccgccgcaggca

SEQ ID NO: 4282 - RNA, 23 nt, Artificial Sequence
  source: /note="Description of Artificial Sequence: Synthetic oligonucleotide"
ugcugaggcagcagcggcugugc

SEQ ID NO: 4283 - RNA, 23 nt, Artificial Sequence
  source: /note="Description of Artificial Sequence: Synthetic oligonucleotide"
uagcggcugugccugcggcggcg

SEQ ID NO: 4284 - RNA, 23 nt, Artificial Sequence
  source: /note="Description of Artificial Sequence: Synthetic oligonucleotide"
ugucggugcagcggcuccucagc

SEQ ID NO: 4285 - RNA, 23 nt, Artificial Sequence
  source: /note="Description of Artificial Sequence: Synthetic oligonucleotide"
uucggugcagcggcuccucagcc

SEQ ID NO: 4286 - RNA, 23 nt, Artificial Sequence
  source: /note="Description of Artificial Sequence: Synthetic oligonucleotide"
uugcagcggcuccucagccacag

SEQ ID NO: 4287 - RNA, 23 nt, Artificial Sequence
  source: /note="Description of Artificial Sequence: Synthetic oligonucleotide"
ugaggcagcagcggcugugccug

SEQ ID NO: 4288 - RNA, 23 nt, Artificial Sequence
  source: /note="Description of Artificial Sequence: Synthetic oligonucleotide"
ucugaggcagcagcggcugugcc

SEQ ID NO: 4289 - RNA, 23 nt, Artificial Sequence
  source: /note="Description of Artificial Sequence: Synthetic oligonucleotide"
uggugcagcggcuccucagccac

SEQ ID NO: 4290 - RNA, 23 nt, Artificial Sequence
  source: /note="Description of Artificial Sequence: Synthetic oligonucleotide"
uugcggcggcggcugaggaagcu

SEQ ID NO: 4291 - RNA, 23 nt, Artificial Sequence
  source: /note="Description of Artificial Sequence: Synthetic oligonucleotide"
uaggcagcagcggcugugccugc

SEQ ID NO: 4292 - RNA, 23 nt, Artificial Sequence
  source: /note="Description of Artificial Sequence: Synthetic oligonucleotide"
uagcagcggcugugccugcggcg

SEQ ID NO: 4293 - RNA, 23 nt, Artificial Sequence
  source: /note="Description of Artificial Sequence: Synthetic oligonucleotide"
uagcggcuccucagccacagccg

SEQ ID NO: 4294 - RNA, 23 nt, Artificial Sequence
  source: /note="Description of Artificial Sequence: Synthetic oligonucleotide"
uugaggcagcagcggcugugccu

SEQ ID NO: 4295 - RNA, 23 nt, Artificial Sequence
  source: /note="Description of Artificial Sequence: Synthetic oligonucleotide"
ugcagcagcggcugugccugcgg

SEQ ID NO: 4296 - RNA, 23 nt, Artificial Sequence
  source: /note="Description of Artificial Sequence: Synthetic oligonucleotide"
ucggugcagcggcuccucagcca

SEQ ID NO: 4297 - RNA, 23 nt, Artificial Sequence
  source: /note="Description of Artificial Sequence: Synthetic oligonucleotide"
uugcggcugaggcagcagcggcu

SEQ ID NO: 4298 - RNA, 23 nt, Artificial Sequence
  source: /note="Description of Artificial Sequence: Synthetic oligonucleotide"
ugcagcggcugugccugcggcgg

SEQ ID NO: 4299 - RNA, 23 nt, Artificial Sequence
  source: /note="Description of Artificial Sequence: Synthetic oligonucleotide"
uggcuccucagccacagccgggc

SEQ ID NO: 4300 - RNA, 23 nt, Artificial Sequence
  source: /note="Description of Artificial Sequence: Synthetic oligonucleotide"
uggcagcagcggcugugccugcg

SEQ ID NO: 4301 - RNA, 23 nt, Artificial Sequence
  source: /note="Description of Artificial Sequence: Synthetic oligonucleotide"
ucagcggcugugccugcggcggc

SEQ ID NO: 4302 - RNA, 23 nt, Artificial Sequence
  source: /note="Description of Artificial Sequence: Synthetic oligonucleotide"
ucagcggcuccucagccacagcc

SEQ ID NO: 4303 - RNA, 23 nt, Artificial Sequence
  source: /note="Description of Artificial Sequence: Synthetic oligonucleotide"
uggcugaggcagcagcggcugug

SEQ ID NO: 4304 - RNA, 23 nt, Artificial Sequence
  source: /note="Description of Artificial Sequence: Synthetic oligonucleotide"
ugcugugccugcggcggcggcug

SEQ ID NO: 4305 - RNA, 23 nt, Artificial Sequence
  source: /note="Description of Artificial Sequence: Synthetic oligonucleotide"
ugcggcuccucagccacagccgg

SEQ ID NO: 4306 - RNA, 23 nt, Artificial Sequence
  source: /note="Description of Artificial Sequence: Synthetic oligonucleotide"
ugugcagcggcuccucagccaca

SEQ ID NO: 4307 - RNA, 23 nt, Artificial Sequence
  source: /note="Description of Artificial Sequence: Synthetic oligonucleotide"
ucggcuccucagccacagccggg

SEQ ID NO: 4308 - RNA, 23 nt, Artificial Sequence
  source: /note="Description of Artificial Sequence: Synthetic oligonucleotide"
uuccucagccacagccgggccgg

SEQ ID NO: 4309 - RNA, 23 nt, Artificial Sequence
  source: /note="Description of Artificial Sequence: Synthetic oligonucleotide"
ugugccugcggcggcggcugagg

SEQ ID NO: 4310 - RNA, 23 nt, Artificial Sequence
  source: /note="Description of Artificial Sequence: Synthetic oligonucleotide"
ucagcagcggcugugccugcggc

SEQ ID NO: 4311 - RNA, 23 nt, Artificial Sequence
  source: /note="Description of Artificial Sequence: Synthetic oligonucleotide"
ugcggcugaggcagcagcggcug

SEQ ID NO: 4312 - RNA, 23 nt, Artificial Sequence
  source: /note="Description of Artificial Sequence: Synthetic oligonucleotide"
ucucagccacagccgggccgggu

SEQ ID NO: 4313 - RNA, 23 nt, Artificial Sequence
  source: /note="Description of Artificial Sequence: Synthetic oligonucleotide"
uccucagccacagccgggccggg

SEQ ID NO: 4314 - RNA, 23 nt, Artificial Sequence
  source: /note="Description of Artificial Sequence: Synthetic oligonucleotide"
ugcagcggcuccucagccacagc

SEQ ID NO: 4315 - RNA, 23 nt, Artificial Sequence
  source: /note="Description of Artificial Sequence: Synthetic oligonucleotide"
ucugugccugcggcggcggcuga

SEQ ID NO: 4316 - RNA, 23 nt, Artificial Sequence
  source: /note="Description of Artificial Sequence: Synthetic oligonucleotide"
ucuccucagccacagccgggccg

SEQ ID NO: 4317 - RNA, 23 nt, Artificial Sequence
  source: /note="Description of Artificial Sequence: Synthetic oligonucleotide"
ucggcugaggcagcagcggcugu

SEQ ID NO: 4318 - RNA, 23 nt, Artificial Sequence
  source: /note="Description of Artificial Sequence: Synthetic oligonucleotide"
uggcugugccugcggcggcggcu

SEQ ID NO: 4319 - RNA, 23 nt, Artificial Sequence
  source: /note="Description of Artificial Sequence: Synthetic oligonucleotide"
ucugcggcggcggcugaggaagc

SEQ ID NO: 4320 - RNA, 23 nt, Artificial Sequence
  source: /note="Description of Artificial Sequence: Synthetic oligonucleotide"
uugugccugcggcggcggcugag

SEQ ID NO: 4321 - RNA, 23 nt, Artificial Sequence
  source: /note="Description of Artificial Sequence: Synthetic oligonucleotide"
uugccugcggcggcggcugagga

SEQ ID NO: 4322 - RNA, 23 nt, Artificial Sequence
  source: /note="Description of Artificial Sequence: Synthetic oligonucleotide"
ugcggcugugccugcggcggcgg

SEQ ID NO: 4323 - RNA, 23 nt, Artificial Sequence
  source: /note="Description of Artificial Sequence: Synthetic oligonucleotide"
ugcuccucagccacagccgggcc

SEQ ID NO: 4324 - RNA, 23 nt, Artificial Sequence
  source: /note="Description of Artificial Sequence: Synthetic oligonucleotide"
ucggcugugccugcggcggcggc

SEQ ID NO: 4325 - RNA, 23 nt, Artificial Sequence
  source: /note="Description of Artificial Sequence: Synthetic oligonucleotide"
uccugcggcggcggcugaggaag

SEQ ID NO: 4326 - RNA, 23 nt, Artificial Sequence
  source: /note="Description of Artificial Sequence: Synthetic oligonucleotide"
ugccugcggcggcggcugaggaa

SEQ ID NO: 4327 - RNA, 23 nt, Artificial Sequence
  source: /note="Description of Artificial Sequence: Synthetic oligonucleotide"
gcacagccgcugcugccucagcc

SEQ ID NO: 4328 - RNA, 23 nt, Artificial Sequence
  source: /note="Description of Artificial Sequence: Synthetic oligonucleotide"
cgccgccgcaggcacagccgcug

SEQ ID NO: 4329 - RNA, 23 nt, Artificial Sequence
  source: /note="Description of Artificial Sequence: Synthetic oligonucleotide"
gcugaggagccgcugcaccgacc

SEQ ID NO: 4330 - RNA, 23 nt, Artificial Sequence
  source: /note="Description of Artificial Sequence: Synthetic oligonucleotide"
ggcugaggagccgcugcaccgac

SEQ ID NO: 4331 - RNA, 23 nt, Artificial Sequence
  source: /note="Description of Artificial Sequence: Synthetic oligonucleotide"
cuguggcugaggagccgcugcac

SEQ ID NO: 4332 - RNA, 23 nt, Artificial Sequence
  source: /note="Description of Artificial Sequence: Synthetic oligonucleotide"
caggcacagccgcugcugccuca

SEQ ID NO: 4333 - RNA, 23 nt, Artificial Sequence
  source: /note="Description of Artificial Sequence: Synthetic oligonucleotide"
ggcacagccgcugcugccucagc

SEQ ID NO: 4334 - RNA, 23 nt, Artificial Sequence
  source: /note="Description of Artificial Sequence: Synthetic oligonucleotide"
guggcugaggagccgcugcaccg

SEQ ID NO: 4335 - RNA, 23 nt, Artificial Sequence
  source: /note="Description of Artificial Sequence: Synthetic oligonucleotide"
agcuuccucagccgccgccgcag

SEQ ID NO: 4336 - RNA, 23 nt, Artificial Sequence
  source: /note="Description of Artificial Sequence: Synthetic oligonucleotide"
gcaggcacagccgcugcugccuc

SEQ ID NO: 4337 - RNA, 23 nt, Artificial Sequence
  source: /note="Description of Artificial Sequence: Synthetic oligonucleotide"
cgccgcaggcacagccgcugcug

SEQ ID NO: 4338 - RNA, 23 nt, Artificial Sequence
  source: /note="Description of Artificial Sequence: Synthetic oligonucleotide"
cggcuguggcugaggagccgcug

SEQ ID NO: 4339 - RNA, 23 nt, Artificial Sequence
  source: /note="Description of Artificial Sequence: Synthetic oligonucleotide"
aggcacagccgcugcugccucag

SEQ ID NO: 4340 - RNA, 23 nt, Artificial Sequence
  source: /note="Description of Artificial Sequence: Synthetic oligonucleotide"
ccgcaggcacagccgcugcugcc

SEQ ID NO: 4341 - RNA, 23 nt, Artificial Sequence
  source: /note="Description of Artificial Sequence: Synthetic oligonucleotide"
uggcugaggagccgcugcaccga

SEQ ID NO: 4342 - RNA, 23 nt, Artificial Sequence
  source: /note="Description of Artificial Sequence: Synthetic oligonucleotide"
agccgcugcugccucagccgcag

SEQ ID NO: 4343 - RNA, 23 nt, Artificial Sequence
  source: /note="Description of Artificial Sequence: Synthetic oligonucleotide"
ccgccgcaggcacagccgcugcu

SEQ ID NO: 4344 - RNA, 23 nt, Artificial Sequence
  source: /note="Description of Artificial Sequence: Synthetic oligonucleotide"
gcccggcuguggcugaggagccg

SEQ ID NO: 4345 - RNA, 23 nt, Artificial Sequence
  source: /note="Description of Artificial Sequence: Synthetic oligonucleotide"
cgcaggcacagccgcugcugccu

SEQ ID NO: 4346 - RNA, 23 nt, Artificial Sequence
  source: /note="Description of Artificial Sequence: Synthetic oligonucleotide"
gccgccgcaggcacagccgcugc

SEQ ID NO: 4347 - RNA, 23 nt, Artificial Sequence
  source: /note="Description of Artificial Sequence: Synthetic oligonucleotide"
ggcuguggcugaggagccgcugc

SEQ ID NO: 4348 - RNA, 23 nt, Artificial Sequence
  source: /note="Description of Artificial Sequence: Synthetic oligonucleotide"
cacagccgcugcugccucagccg

SEQ ID NO: 4349 - RNA, 23 nt, Artificial Sequence
  source: /note="Description of Artificial Sequence: Synthetic oligonucleotide"
cagccgccgccgcaggcacagcc

SEQ ID NO: 4350 - RNA, 23 nt, Artificial Sequence
  source: /note="Description of Artificial Sequence: Synthetic oligonucleotide"
ccggcuguggcugaggagccgcu

SEQ ID NO: 4351 - RNA, 23 nt, Artificial Sequence
  source: /note="Description of Artificial Sequence: Synthetic oligonucleotide"
uguggcugaggagccgcugcacc

SEQ ID NO: 4352 - RNA, 23 nt, Artificial Sequence
  source: /note="Description of Artificial Sequence: Synthetic oligonucleotide"
cccggcuguggcugaggagccgc

SEQ ID NO: 4353 - RNA, 23 nt, Artificial Sequence
  source: /note="Description of Artificial Sequence: Synthetic oligonucleotide"
ccggcccggcuguggcugaggag

SEQ ID NO: 4354 - RNA, 23 nt, Artificial Sequence
  source: /note="Description of Artificial Sequence: Synthetic oligonucleotide"
ccucagccgccgccgcaggcaca

SEQ ID NO: 4355 - RNA, 23 nt, Artificial Sequence
  source: /note="Description of Artificial Sequence: Synthetic oligonucleotide"
gccgcaggcacagccgcugcugc

SEQ ID NO: 4356 - RNA, 23 nt, Artificial Sequence
  source: /note="Description of Artificial Sequence: Synthetic oligonucleotide"
cagccgcugcugccucagccgca

SEQ ID NO: 4357 - RNA, 23 nt, Artificial Sequence
  source: /note="Description of Artificial Sequence: Synthetic oligonucleotide"
acccggcccggcuguggcugagg

SEQ ID NO: 4358 - RNA, 23 nt, Artificial Sequence
  source: /note="Description of Artificial Sequence: Synthetic oligonucleotide"
cccggcccggcuguggcugagga

SEQ ID NO: 4359 - RNA, 23 nt, Artificial Sequence
  source: /note="Description of Artificial Sequence: Synthetic oligonucleotide"
gcuguggcugaggagccgcugca

SEQ ID NO: 4360 - RNA, 23 nt, Artificial Sequence
  source: /note="Description of Artificial Sequence: Synthetic oligonucleotide"
ucagccgccgccgcaggcacagc

SEQ ID NO: 4361 - RNA, 23 nt, Artificial Sequence
  source: /note="Description of Artificial Sequence: Synthetic oligonucleotide"
cggcccggcuguggcugaggagc

SEQ ID NO: 4362 - RNA, 23 nt, Artificial Sequence
  source: /note="Description of Artificial Sequence: Synthetic oligonucleotide"
acagccgcugcugccucagccgc

SEQ ID NO: 4363 - RNA, 23 nt, Artificial Sequence
  source: /note="Description of Artificial Sequence: Synthetic oligonucleotide"
agccgccgccgcaggcacagccg

SEQ ID NO: 4364 - RNA, 23 nt, Artificial Sequence
  source: /note="Description of Artificial Sequence: Synthetic oligonucleotide"
gcuuccucagccgccgccgcagg

SEQ ID NO: 4365 - RNA, 23 nt, Artificial Sequence
  source: /note="Description of Artificial Sequence: Synthetic oligonucleotide"
cucagccgccgccgcaggcacag

SEQ ID NO: 4366 - RNA, 23 nt, Artificial Sequence
  source: /note="Description of Artificial Sequence: Synthetic oligonucleotide"
uccucagccgccgccgcaggcac

SEQ ID NO: 4367 - RNA, 23 nt, Artificial Sequence
  source: /note="Description of Artificial Sequence: Synthetic oligonucleotide"
ccgccgccgcaggcacagccgcu

SEQ ID NO: 4368 - RNA, 23 nt, Artificial Sequence
  source: /note="Description of Artificial Sequence: Synthetic oligonucleotide"
ggcccggcuguggcugaggagcc

SEQ ID NO: 4369 - RNA, 23 nt, Artificial Sequence
  source: /note="Description of Artificial Sequence: Synthetic oligonucleotide"
gccgccgccgcaggcacagccgc

SEQ ID NO: 4370 - RNA, 23 nt, Artificial Sequence
  source: /note="Description of Artificial Sequence: Synthetic oligonucleotide"
cuuccucagccgccgccgcaggc

SEQ ID NO: 4371 - RNA, 23 nt, Artificial Sequence
  source: /note="Description of Artificial Sequence: Synthetic oligonucleotide"
uuccucagccgccgccgcaggca

SEQ ID NO: 4372 - RNA, 21 nt, Artificial Sequence
  source: /note="Description of Artificial Sequence: Synthetic oligonucleotide"
acagccgcugcugccucagca

SEQ ID NO: 4373 - RNA, 21 nt, Artificial Sequence
  source: /note="Description of Artificial Sequence: Synthetic oligonucleotide"
ccgccgcaggcacagccgcua

SEQ ID NO: 4374 - RNA, 21 nt, Artificial Sequence
  source: /note="Description of Artificial Sequence: Synthetic oligonucleotide"
ugaggagccgcugcaccgaca

SEQ ID NO: 4375 - RNA, 21 nt, Artificial Sequence
  source: /note="Description of Artificial Sequence: Synthetic oligonucleotide"
cugaggagccgcugcaccgaa

SEQ ID NO: 4376 - RNA, 21 nt, Artificial Sequence
  source: /note="Description of Artificial Sequence: Synthetic oligonucleotide"
guggcugaggagccgcugcaa

SEQ ID NO: 4377 - RNA, 21 nt, Artificial Sequence
  source: /note="Description of Artificial Sequence: Synthetic oligonucleotide"
ggcacagccgcugcugccuca

SEQ ID NO: 4378 - RNA, 21 nt, Artificial Sequence
  source: /note="Description of Artificial Sequence: Synthetic oligonucleotide"
cacagccgcugcugccucaga

SEQ ID NO: 4379 - RNA, 21 nt, Artificial Sequence
  source: /note="Description of Artificial Sequence: Synthetic oligonucleotide"
ggcugaggagccgcugcacca

SEQ ID NO: 4380 - RNA, 21 nt, Artificial Sequence
  source: /note="Description of Artificial Sequence: Synthetic oligonucleotide"
cuuccucagccgccgccgcaa

SEQ ID NO: 4381 - RNA, 21 nt, Artificial Sequence
  source: /note="Description of Artificial Sequence: Synthetic oligonucleotide"
aggcacagccgcugcugccua

SEQ ID NO: 4382 - RNA, 21 nt, Artificial Sequence
  source: /note="Description of Artificial Sequence: Synthetic oligonucleotide"
ccgcaggcacagccgcugcua

SEQ ID NO: 4383 - RNA, 21 nt, Artificial Sequence
  source: /note="Description of Artificial Sequence: Synthetic oligonucleotide"
gcuguggcugaggagccgcua

SEQ ID NO: 4384 - RNA, 21 nt, Artificial Sequence
  source: /note="Description of Artificial Sequence: Synthetic oligonucleotide"
gcacagccgcugcugccucaa

SEQ ID NO: 4385 - RNA, 21 nt, Artificial Sequence
  source: /note="Description of Artificial Sequence: Synthetic oligonucleotide"
gcaggcacagccgcugcugca

SEQ ID NO: 4386 - RNA, 21 nt, Artificial Sequence
  source: /note="Description of Artificial Sequence: Synthetic oligonucleotide"
gcugaggagccgcugcaccga

SEQ ID NO: 4387 - RNA, 21 nt, Artificial Sequence
  source: /note="Description of Artificial Sequence: Synthetic oligonucleotide"
ccgcugcugccucagccgcaa

SEQ ID NO: 4388 - RNA, 21 nt, Artificial Sequence
  source: /note="Description of Artificial Sequence: Synthetic oligonucleotide"
gccgcaggcacagccgcugca

SEQ ID NO: 4389 - RNA, 21 nt, Artificial Sequence
  source: /note="Description of Artificial Sequence: Synthetic oligonucleotide"
ccggcuguggcugaggagcca

SEQ ID NO: 4390 - RNA, 21 nt, Artificial Sequence
  source: /note="Description of Artificial Sequence: Synthetic oligonucleotide"
caggcacagccgcugcugcca

SEQ ID NO: 4391 - RNA, 21 nt, Artificial Sequence
  source: /note="Description of Artificial Sequence: Synthetic oligonucleotide"
cgccgcaggcacagccgcuga

SEQ ID NO: 4392 - RNA, 21 nt, Artificial Sequence
  source: /note="Description of Artificial Sequence: Synthetic oligonucleotide"
cuguggcugaggagccgcuga

SEQ ID NO: 4393 - RNA, 21 nt, Artificial Sequence
  source: /note="Description of Artificial Sequence: Synthetic oligonucleotide"
cagccgcugcugccucagcca

SEQ ID NO: 4394 - RNA, 21 nt, Artificial Sequence
  source: /note="Description of Artificial Sequence: Synthetic oligonucleotide"
gccgccgccgcaggcacagca

SEQ ID NO: 4395 - RNA, 21 nt, Artificial Sequence
  source: /note="Description of Artificial Sequence: Synthetic oligonucleotide"
ggcuguggcugaggagccgca

SEQ ID NO: 4396 - RNA, 21 nt, Artificial Sequence
  source: /note="Description of Artificial Sequence: Synthetic oligonucleotide"
uggcugaggagccgcugcaca

SEQ ID NO: 4397 - RNA, 21 nt, Artificial Sequence
  source: /note="Description of Artificial Sequence: Synthetic oligonucleotide"
cggcuguggcugaggagccga

SEQ ID NO: 4398 - RNA, 21 nt, Artificial Sequence
  source: /note="Description of Artificial Sequence: Synthetic oligonucleotide"
ggcccggcuguggcugaggaa

SEQ ID NO: 4399 - RNA, 21 nt, Artificial Sequence
  source: /note="Description of Artificial Sequence: Synthetic oligonucleotide"
ucagccgccgccgcaggcaca

SEQ ID NO: 4400 - RNA, 21 nt, Artificial Sequence
  source: /note="Description of Artificial Sequence: Synthetic oligonucleotide"
cgcaggcacagccgcugcuga

SEQ ID NO: 4401 - RNA, 21 nt, Artificial Sequence
  source: /note="Description of Artificial Sequence: Synthetic oligonucleotide"
gccgcugcugccucagccgca

SEQ ID NO: 4402 - RNA, 21 nt, Artificial Sequence
  source: /note="Description of Artificial Sequence: Synthetic oligonucleotide"
ccggcccggcuguggcugaga

SEQ ID NO: 4403 - RNA, 21 nt, Artificial Sequence
  source: /note="Description of Artificial Sequence: Synthetic oligonucleotide"
cggcccggcuguggcugagga

SEQ ID NO: 4404 - RNA, 21 nt, Artificial Sequence
  source: /note="Description of Artificial Sequence: Synthetic oligonucleotide"
uguggcugaggagccgcugca

SEQ ID NO: 4405 - RNA, 21 nt, Artificial Sequence
  source: /note="Description of Artificial Sequence: Synthetic oligonucleotide"
agccgccgccgcaggcacaga

SEQ ID NO: 4406 - RNA, 21 nt, Artificial Sequence
  source: /note="Description of Artificial Sequence: Synthetic oligonucleotide"
gcccggcuguggcugaggaga

SEQ ID NO: 4407 - RNA, 21 nt, Artificial Sequence
  source: /note="Description of Artificial Sequence: Synthetic oligonucleotide"
agccgcugcugccucagccga

SEQ ID NO: 4408 - RNA, 21 nt, Artificial Sequence
  source: /note="Description of Artificial Sequence: Synthetic oligonucleotide"
ccgccgccgcaggcacagcca

SEQ ID NO: 4409 - RNA, 21 nt, Artificial Sequence
  source: /note="Description of Artificial Sequence: Synthetic oligonucleotide"
uuccucagccgccgccgcaga

SEQ ID NO: 4410 - RNA, 21 nt, Artificial Sequence
  source: /note="Description of Artificial Sequence: Synthetic oligonucleotide"
cagccgccgccgcaggcacaa

SEQ ID NO: 4411 - RNA, 21 nt, Artificial Sequence
  source: /note="Description of Artificial Sequence: Synthetic oligonucleotide"
cucagccgccgccgcaggcaa

SEQ ID NO: 4412 - RNA, 21 nt, Artificial Sequence
  source: /note="Description of Artificial Sequence: Synthetic oligonucleotide"
gccgccgcaggcacagccgca

SEQ ID NO: 4413 - RNA, 21 nt, Artificial Sequence
  source: /note="Description of Artificial Sequence: Synthetic oligonucleotide"
cccggcuguggcugaggagca

SEQ ID NO: 4414 - RNA, 21 nt, Artificial Sequence
  source: /note="Description of Artificial Sequence: Synthetic oligonucleotide"
cgccgccgcaggcacagccga

SEQ ID NO: 4415 - RNA, 21 nt, Artificial Sequence
  source: /note="Description of Artificial Sequence: Synthetic oligonucleotide"
uccucagccgccgccgcagga

SEQ ID NO: 4416 - RNA, 21 nt, Artificial Sequence
  source: /note="Description of Artificial Sequence: Synthetic oligonucleotide"
ccucagccgccgccgcaggca

SEQ ID NO: 4417 - RNA, 23 nt, Artificial Sequence
  source: /note="Description of Artificial Sequence: Synthetic oligonucleotide"
ugcugaggcagcagcggcugugc

SEQ ID NO: 4418 - RNA, 23 nt, Artificial Sequence
  source: /note="Description of Artificial Sequence: Synthetic oligonucleotide"
uagcggcugugccugcggcggcg

SEQ ID NO: 4419 - RNA, 23 nt, Artificial Sequence
  source: /note="Description of Artificial Sequence: Synthetic oligonucleotide"
ugucggugcagcggcuccucagc

SEQ ID NO: 4420 - RNA, 23 nt, Artificial Sequence
  source: /note="Description of Artificial Sequence: Synthetic oligonucleotide"
uucggugcagcggcuccucagcc

SEQ ID NO: 4421 - RNA, 23 nt, Artificial Sequence
  source: /note="Description of Artificial Sequence: Synthetic oligonucleotide"
uugcagcggcuccucagccacag

SEQ ID NO: 4422 - RNA, 23 nt, Artificial Sequence
  source: /note="Description of Artificial Sequence: Synthetic oligonucleotide"
ugaggcagcagcggcugugccug

SEQ ID NO: 4423 - RNA, 23 nt, Artificial Sequence
  source: /note="Description of Artificial Sequence: Synthetic oligonucleotide"
ucugaggcagcagcggcugugcc

SEQ ID NO: 4424 - RNA, 23 nt, Artificial Sequence
  source: /note="Description of Artificial Sequence: Synthetic oligonucleotide"
uggugcagcggcuccucagccac

SEQ ID NO: 4425 - RNA, 23 nt, Artificial Sequence
  source: /note="Description of Artificial Sequence: Synthetic oligonucleotide"
uugcggcggcggcugaggaagcu

SEQ ID NO: 4426 - RNA, 23 nt, Artificial Sequence
  source: /note="Description of Artificial Sequence: Synthetic oligonucleotide"
uaggcagcagcggcugugccugc

SEQ ID NO: 4427 - RNA, 23 nt, Artificial Sequence
  source: /note="Description of Artificial Sequence: Synthetic oligonucleotide"
uagcagcggcugugccugcggcg

SEQ ID NO: 4428 - RNA, 23 nt, Artificial Sequence
  source: /note="Description of Artificial Sequence: Synthetic oligonucleotide"
uagcggcuccucagccacagccg

SEQ ID NO: 4429 - RNA, 23 nt, Artificial Sequence
  source: /note="Description of Artificial Sequence: Synthetic oligonucleotide"
uugaggcagcagcggcugugccu

SEQ ID NO: 4430 - RNA, 23 nt, Artificial Sequence
  source: /note="Description of Artificial Sequence: Synthetic oligonucleotide"
ugcagcagcggcugugccugcgg

SEQ ID NO: 4431 - RNA, 23 nt, Artificial Sequence
  source: /note="Description of Artificial Sequence: Synthetic oligonucleotide"
ucggugcagcggcuccucagcca

SEQ ID NO: 4432 - RNA, 23 nt, Artificial Sequence
  source: /note="Description of Artificial Sequence: Synthetic oligonucleotide"
uugcggcugaggcagcagcggcu

SEQ ID NO: 4433 - RNA, 23 nt, Artificial Sequence
  source: /note="Description of Artificial Sequence: Synthetic oligonucleotide"
ugcagcggcugugccugcggcgg

SEQ ID NO: 4434 - RNA, 23 nt, Artificial Sequence
  source: /note="Description of Artificial Sequence: Synthetic oligonucleotide"
uggcuccucagccacagccgggc

SEQ ID NO: 4435 - RNA, 23 nt, Artificial Sequence
  source: /note="Description of Artificial Sequence: Synthetic oligonucleotide"
uggcagcagcggcugugccugcg

SEQ ID NO: 4436 - RNA, 23 nt, Artificial Sequence
  source: /note="Description of Artificial Sequence: Synthetic oligonucleotide"
ucagcggcugugccugcggcggc

SEQ ID NO: 4437 - RNA, 23 nt, Artificial Sequence
  source: /note="Description of Artificial Sequence: Synthetic oligonucleotide"
ucagcggcuccucagccacagcc

SEQ ID NO: 4438 - RNA, 23 nt, Artificial Sequence
  source: /note="Description of Artificial Sequence: Synthetic oligonucleotide"
uggcugaggcagcagcggcugug

SEQ ID NO: 4439 - RNA, 23 nt, Artificial Sequence
  source: /note="Description of Artificial Sequence: Synthetic oligonucleotide"
ugcugugccugcggcggcggcug

SEQ ID NO: 4440 - RNA, 23 nt, Artificial Sequence
  source: /note="Description of Artificial Sequence: Synthetic oligonucleotide"
ugcggcuccucagccacagccgg

SEQ ID NO: 4441 - RNA, 23 nt, Artificial Sequence
  source: /note="Description of Artificial Sequence: Synthetic oligonucleotide"
ugugcagcggcuccucagccaca

SEQ ID NO: 4442 - RNA, 23 nt, Artificial Sequence
  source: /note="Description of Artificial Sequence: Synthetic oligonucleotide"
ucggcuccucagccacagccggg

SEQ ID NO: 4443 - RNA, 23 nt, Artificial Sequence
  source: /note="Description of Artificial Sequence: Synthetic oligonucleotide"
uuccucagccacagccgggccgg

SEQ ID NO: 4444 - RNA, 23 nt, Artificial Sequence
  source: /note="Description of Artificial Sequence: Synthetic oligonucleotide"
ugugccugcggcggcggcugagg

SEQ ID NO: 4445 - RNA, 23 nt, Artificial Sequence
  source: /note="Description of Artificial Sequence: Synthetic oligonucleotide"
ucagcagcggcugugccugcggc

SEQ ID NO: 4446 - RNA, 23 nt, Artificial Sequence
  source: /note="Description of Artificial Sequence: Synthetic oligonucleotide"
ugcggcugaggcagcagcggcug

SEQ ID NO: 4447 - RNA, 23 nt, Artificial Sequence
  source: /note="Description of Artificial Sequence: Synthetic oligonucleotide"
ucucagccacagccgggccgggu

SEQ ID NO: 4448 - RNA, 23 nt, Artificial Sequence
  source: /note="Description of Artificial Sequence: Synthetic oligonucleotide"
uccucagccacagccgggccggg

SEQ ID NO: 4449 - RNA, 23 nt, Artificial Sequence
  source: /note="Description of Artificial Sequence: Synthetic oligonucleotide"
ugcagcggcuccucagccacagc

SEQ ID NO: 4450 - RNA, 23 nt, Artificial Sequence
  source: /note="Description of Artificial Sequence: Synthetic oligonucleotide"
ucugugccugcggcggcggcuga

SEQ ID NO: 4451 - RNA, 23 nt, Artificial Sequence
  source: /note="Description of Artificial Sequence: Synthetic oligonucleotide"
ucuccucagccacagccgggccg

SEQ ID NO: 4452 - RNA, 23 nt, Artificial Sequence
  source: /note="Description of Artificial Sequence: Synthetic oligonucleotide"
ucggcugaggcagcagcggcugu

SEQ ID NO: 4453 - RNA, 23 nt, Artificial Sequence
  source: /note="Description of Artificial Sequence: Synthetic oligonucleotide"
uggcugugccugcggcggcggcu

SEQ ID NO: 4454 - RNA, 23 nt, Artificial Sequence
  source: /note="Description of Artificial Sequence: Synthetic oligonucleotide"
ucugcggcggcggcugaggaagc

SEQ ID NO: 4455 - RNA, 23 nt, Artificial Sequence
  source: /note="Description of Artificial Sequence: Synthetic oligonucleotide"
uugugccugcggcggcggcugag

SEQ ID NO: 4456 - RNA, 23 nt, Artificial Sequence
  source: /note="Description of Artificial Sequence: Synthetic oligonucleotide"
uugccugcggcggcggcugagga

SEQ ID NO: 4457 - RNA, 23 nt, Artificial Sequence
  source: /note="Description of Artificial Sequence: Synthetic oligonucleotide"
ugcggcugugccugcggcggcgg

SEQ ID NO: 4458 - RNA, 23 nt, Artificial Sequence
  source: /note="Description of Artificial Sequence: Synthetic oligonucleotide"
ugcuccucagccacagccgggcc

SEQ ID NO: 4459 - RNA, 23 nt, Artificial Sequence
  source: /note="Description of Artificial Sequence: Synthetic oligonucleotide"
ucggcugugccugcggcggcggc

SEQ ID NO: 4460 - RNA, 23 nt, Artificial Sequence
  source: /note="Description of Artificial Sequence: Synthetic oligonucleotide"
uccugcggcggcggcugaggaag

SEQ ID NO: 4461 - RNA, 23 nt, Artificial Sequence
  source: /note="Description of Artificial Sequence: Synthetic oligonucleotide"
ugccugcggcggcggcugaggaa

SEQ ID NO: 4462 - RNA, 21 nt, Artificial Sequence
  source: /note="Description of Artificial Sequence: Synthetic oligonucleotide"
cugaugaaggccuucgaguca

SEQ ID NO: 4463 - RNA, 21 nt, Artificial Sequence
  source: /note="Description of Artificial Sequence: Synthetic oligonucleotide"
cugaagaaggccuucgaguca

SEQ ID NO: 4464 - RNA, 21 nt, Artificial Sequence
  source: /note="Description of Artificial Sequence: Synthetic oligonucleotide"
gcucagguucugcuuuuacca

SEQ ID NO: 4465 - RNA, 19 nt, Artificial Sequence
  source: /note="Description of Artificial Sequence: Synthetic oligonucleotide"
ucagguucugcuuuuacca

SEQ ID NO: 4466 - RNA, 21 nt, Artificial Sequence
  source: /note="Description of Artificial Sequence: Synthetic oligonucleotide"
cucagguucugcuuuuaccua

SEQ ID NO: 4467 - RNA, 19 nt, Artificial Sequence
  source: /note="Description of Artificial Sequence: Synthetic oligonucleotide"
ucgagucccucaaguccua

SEQ ID NO: 4468 - RNA, 21 nt, Artificial Sequence
  source: /note="Description of Artificial Sequence: Synthetic oligonucleotide"
cuuggagucccucaaguccua

SEQ ID NO: 4469 - RNA, 21 nt, Artificial Sequence
  source: /note="Description of Artificial Sequence: Synthetic oligonucleotide"
gccgcucagguucugcuuuua

SEQ ID NO: 4470 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactcgaaggccuucaucagcu

SEQ ID NO: 4471 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactcgaaggccuucuucagcu

SEQ ID NO: 4472 - RNA, 23 nt, Artificial Sequence
  source: /note="Description of Artificial Sequence: Synthetic oligonucleotide"
ugguaaaagcagaaccugagcgg

SEQ ID NO: 4473 - RNA, 21 nt, Artificial Sequence
  source: /note="Description of Artificial Sequence: Synthetic oligonucleotide"
ugguaaaagcagaaccugagc

SEQ ID NO: 4474 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggtaaaagcagaaccugagcg

SEQ ID NO: 4475 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggactugagggacucgagg

SEQ ID NO: 4476 - RNA, 21 nt, Artificial Sequence
  source: /note="Description of Artificial Sequence: Synthetic oligonucleotide"
uaggacuugagggacucgauc

SEQ ID NO: 4477 - RNA, 23 nt, Artificial Sequence
  source: /note="Description of Artificial Sequence: Synthetic oligonucleotide"
uaggacuugagggacuccaaggc

SEQ ID NO: 4478 - RNA, 23 nt, Artificial Sequence
  source: /note="Description of Artificial Sequence: Synthetic oligonucleotide"
uaaaagcagaaccugagcggccg

SEQ ID NO: 4479 - RNA, 21 nt, Artificial Sequence
  source: /note="Description of Artificial Sequence: Synthetic oligonucleotide"
gcucagguucugcuuuuaccu

SEQ ID NO: 4480 - RNA, 21 nt, Artificial Sequence
  source: /note="Description of Artificial Sequence: Synthetic oligonucleotide"
cuucgagucccucaaguccuu

SEQ ID NO: 4481 - RNA, 21 nt, Artificial Sequence
  source: /note="Description of Artificial Sequence: Synthetic oligonucleotide"
cugaagaaggccuucgaguca

SEQ ID NO: 4482 - RNA, 19 nt, Artificial Sequence
  source: /note="Description of Artificial Sequence: Synthetic oligonucleotide"
ucagguucugcuuuuacca

SEQ ID NO: 4483 - RNA, 19 nt, Artificial Sequence
  source: /note="Description of Artificial Sequence: Synthetic oligonucleotide"
ucgagucccucaaguccua

SEQ ID NO: 4484 - RNA, 21 nt, Artificial Sequence
  source: /note="Description of Artificial Sequence: Synthetic oligonucleotide"
cuuggagucccucaaguccua

SEQ ID NO: 4485 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactcgaaggccuucaucagcu

SEQ ID NO: 4486 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugactcgaaggccuucuucagcu

SEQ ID NO: 4487 - RNA, 21 nt, Artificial Sequence
  source: /note="Description of Artificial Sequence: Synthetic oligonucleotide"
ugguaaaagcagaaccugagc

SEQ ID NO: 4488 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaggtaaaagcagaaccugagcg

SEQ ID NO: 4489 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggactugagggacucgagg

SEQ ID NO: 4490 - RNA, 21 nt, Artificial Sequence
  source: /note="Description of Artificial Sequence: Synthetic oligonucleotide"
uaggacuugagggacucgauc

SEQ ID NO: 4491 - RNA, 23 nt, Artificial Sequence
  source: /note="Description of Artificial Sequence: Synthetic oligonucleotide"
uaggacuugagggacuccaaggc

We claim:

1. A double stranded ribonucleic acid (dsRNA) agent for inhibiting expression of Huntingtin (HTT), or a salt thereof, wherein the dsRNA agent, or a salt thereof, comprises a sense strand and an antisense strand forming a double stranded region, wherein the antisense strand comprises at least 15 contiguous nucleotides from the nucleotide sequence 5'-UAUCAGCUUUUCCAGGGUCGCCG-3' of SEQ ID NO: 4200, wherein all of the nucleotide of the sense strand and all of the nucleotides of the antisense strand comprise a nucleotide modification, and wherein one or more lipophilic moieties are conjugated to one or more internal positions on the sense strand.

2. The dsRNA agent, or a salt thereof, of claim 1, wherein the one or more lipophilic moieties are conjugated to one or more of the internal positions selected from the group consisting of positions 4-8 and 13-18 on the sense strand, counting from the 5'-end of the strand.

3. The dsRNA agent, or a salt thereof, of claim 2, wherein the one or more lipophilic moieties are conjugated to one or more of the internal positions selected from the group consisting of positions 5, 6, 7, 15, and 17 on the sense strand, counting from the 5'-end of the strand.

4. The dsRNA agent, or a salt thereof, of claim 1, wherein the lipophilic moiety is an aliphatic, alicyclic, or polyalicyclic compound.

5. The dsRNA agent, or a salt thereof, of claim 1, wherein the lipophilic moiety contains a saturated or unsaturated C6-C18 hydrocarbon chain.

6. The dsRNA agent, or a salt thereof, of claim 1, wherein the nucleotide modifications are selected from the group consisting of a 2'-O-methyl nucleotide modification, a 2'-fluoro nucleotide modification, and a thermally destabilizing modification, when the thermally destabilizing modification is present, only the antisense strand of the dsRNA agent contains a thermally destabilizing modification.

7. The dsRNA agent, or a salt thereof, of claim 1, further comprising at least one phosphorothioate internucleotide linkage.

8. The dsRNA agent, or a salt thereof, of claim 1, wherein at least one strand comprises a 3' overhang of at least 1 nucleotide.

9. The dsRNA agent, or a salt thereof, of claim 1, wherein the double stranded region is 15-30 nucleotide pairs in length.

10. The dsRNA agent, or a salt thereof, of claim 1, wherein each strand is independently 19-30 nucleotides in length.

11. The dsRNA agent, or a salt thereof, of claim 1, further comprising a phosphate or phosphate mimic at the 5'-end of the antisense strand.

12. The dsRNA agent, or a salt thereof, of claim 1, wherein the sense strand comprises at least 15 contiguous nucleotides from the nucleotide sequence 5'-GCGACCCUGGAAAAGCUGAUA-3' of SEQ ID NO: 3814.

13. The dsRNA agent, or a salt thereof, of claim 7, wherein the dsRNA agent, or a salt thereof, comprises 6-8 phosphorothioate internucleotide linkages.

14. The dsRNA agent, or a salt thereof, of claim 1, wherein each strand is independently 19-23 nucleotides in length.

15. The dsRNA agent, or a salt thereof, of claim 1, wherein each strand is independently 21-23 nucleotides in length.

16. The dsRNA agent, or a salt thereof, of claim 12, wherein only one lipophilic moiety is conjugated to one internal position on the sense strand.

17. The dsRNA agent, or a salt thereof, of claim 16, wherein the lipophilic moiety is conjugated to one of the internal positions selected from the group consisting of positions 4-8 and 13-18 on the sense strand, counting from the 5'-end of the strand.

18. The dsRNA agent, or a salt thereof, of claim 17, wherein the lipophilic moiety is a saturated C16 hydrocarbon chain.

19. The dsRNA agent, or a salt thereof, of claim 16, wherein the nucleotide modifications are selected from the group consisting of a 2'-O-methyl nucleotide modification, a 2'-fluoro nucleotide modification, and a thermally destabilizing modification, when the thermally destabilizing modification is present, only the antisense strand of the dsRNA agent contains a thermally destabilizing modification.

20. The dsRNA agent, or a salt thereof, of claim 16, further comprising 6-8 phosphorothioate internucleotide linkages.

21. The dsRNA agent, or a salt thereof, of claim 16, wherein the antisense strand comprises a 3' overhang of 2 nucleotides.

22. The dsRNA agent, or a salt thereof, of claim 16, wherein the double stranded region is 17-23 nucleotide pairs in length and each strand is independently 17-23 nucleotides in length.

23. The dsRNA agent, or a salt thereof, of claim 16, further comprising a phosphate or phosphate mimic at the 5'-end of the antisense strand.

24. An isolated cell containing the dsRNA agent, or a salt thereof, of claim 1.

25. A pharmaceutical composition for inhibiting expression of a gene encoding HTT, comprising the dsRNA agent, or a salt thereof, of claim 1.

26. A method of inhibiting expression of a huntingtin (HTT) gene in a cell, the method comprising:

(a) contacting the cell with the dsRNA agent, or a salt thereof, of claim 1; and (b) maintaining the cell produced in step (a) for a time sufficient to obtain degradation of the mRNA transcript of the HTT gene, thereby inhibiting expression of the HTT gene in the cell.

27. A method of treating a subject diagnosed with an HTT-associated disease, the method comprising administering to the subject a therapeutically effective amount of the dsRNA agent, or a salt thereof, of claim 1, thereby treating the subject.

28. The method of claim 27, wherein the HTT-associated disease is Huntington's disease.

29. The method of claim 27, wherein the dsRNA agent, or a salt thereof, is administered to the subject intrathecally.

* * * * *